US006818447B1

(12) United States Patent
Pavco et al.

(10) Patent No.: US 6,818,447 B1
(45) Date of Patent: Nov. 16, 2004

(54) METHOD AND REAGENT FOR THE TREATMENT OF DISEASES OR CONDITIONS RELATED TO LEVELS OF VASCULAR ENDOTHELIAL GROWTH FACTOR RECEPTOR

(75) Inventors: Pamela Pavco, Lafayette, CO (US); James McSwiggen, Boulder, CO (US); Daniel Stinchcomb, Boulder, CO (US); Jaime Escobedo, Alamo, CA (US)

(73) Assignee: Sirna Therapeutics, Inc., Boulder, CO (US)

( * ) Notice: Subject to any disclaimer, the term of this patent is extended or adjusted under 35 U.S.C. 154(b) by 159 days.

(21) Appl. No.: 09/685,664

(22) Filed: Oct. 10, 2000

Related U.S. Application Data

(63) Continuation of application No. 08/584,040, filed on Jan. 11, 1996, now Pat. No. 6,346,398.
(60) Provisional application No. 60/005,974, filed on Oct. 26, 1995.

(51) Int. Cl.$^7$ .......................... C12N 5/02; C12N 15/00; C12P 19/34; C07H 21/04
(52) U.S. Cl. .................. 435/325; 536/24.5; 435/91.31; 435/320.1
(58) Field of Search .............................. 536/23.1, 24.5, 536/24.3, 24.33, 24.31; 435/6, 325, 375, 320.1, 91.31; 514/44

(56) References Cited

U.S. PATENT DOCUMENTS

| 4,987,071 A | 1/1991 | Cech et al. |
|---|---|---|
| 5,334,711 A | 8/1994 | Sproat et al. |
| 5,359,051 A | 10/1994 | Cook et al. |
| 5,496,698 A | * 3/1996 | Draper et al. |
| 5,851,999 A | * 12/1998 | Ullrich et al. |

FOREIGN PATENT DOCUMENTS

| EP | 0360257 | 3/1990 |
|---|---|---|
| WO | WO 9103162 | 3/1991 |
| WO | WO 9207065 | 9/1991 |
| WO | WO 9323569 | 4/1993 |
| WO | WO 9315187 | 8/1993 |
| WO | WO 9323057 | 11/1993 |
| WO | WO 9402595 | 2/1994 |
| WO | WO 9411499 | 5/1994 |
| WO | WO9411499 | 5/1994 |
| WO | WO 9421679 | 9/1994 |
| WO | WO9421791 | 9/1994 |
| WO | WO9504142 | 2/1995 |
| WO | WO 9504142 | 2/1995 |
| WO | WO 9504818 | 2/1995 |
| WO | WO 9513380 | 5/1995 |
| WO | WO 9521868 | 8/1995 |
| WO | WO 9523225 | 8/1995 |
| WO | WO9700957 | 1/1997 |
| WO | WO9904819 | 2/1999 |

OTHER PUBLICATIONS

Andrea D. Branch, TIBS 32—Feb. 1998, pp. 45–50.*
Jim Haseloff et al., NATURE, vol. 334, Aug. 18, 1988, pp. 585–591.*
Usman et al., "Chemical modification of hammerhead ribozymes: activity and nuclease resistance," *Nucleic Acids Syposium Series* 31:163–164 (1994).
International Search Report, PCT/US96/17480.
Aiello et al., "Vascular Endothelial Growth Factor in Ocular Fluid of Patients with Diabetic Retinopathy and Other Retinal Disorders" *New Engl. J. Med.* 331:1480–1487 (1994).
Berkman et al., "Expression of the Vascular Permeability Factor/Vascular Endothelial Growth Factor Gene in Central Nervous System Neoplasms" *J. Clini. Invest.* 91:153–159 (1993).
Burger et al., "Expermental Corneal Neovascularization: Biomicroscopic, Angiographic, and Morphologic Correlation" *Cornea* 4:35–41 (1985).
Detmar et al., "Overexpression of Vascular Permeability Factor/Vascular Endothelial Growth Factor and Its Receptors in Psoriasis" *J. Exp. Med.* 180:1141–1146 (1994).
Fava et al., "Vascular Permeability Factor/Endothelial Growth Factor (VPF/VEGF): Accumulation and Expression in Human Synovial Fluids and Rheumatoid Synovial Tissue" *J. Exp. Med.* 180:341–346 (1994).
Ferrara, "Vascular Endothelial Growth Factor" *Trends Cardiovas, Med.* 3:244–250 (1993).
Folkman, "Tumor Angiogenesis" *Adv. Cancer, Res.* 43:175–203 (1985).
Fong, et al., "Role of the Flt–1 receptor tyrosine kinase in regulating the assembly of vascular endothelium" *Nature* 376:66–70 (1995).
Gitay–Goren et al., "The Binding of Vascular Endothelial Growth Factor to Its Receptors Is Dependent on Cell Surface–associated Heparin–like Molecules" *J. Biol. Chem.* 267:6093–6098 (1992).
Grant et al., "Insulin–like growth factor I acts as an angiogenic agent in rabbit cornea and retina: comparative studies with basic fibroblast growth factor" *Diabetologia* 36:282–291 (1993).
Koch et al., "Vascualr Endothelial Growth Factor" *J. Immunol.* 152:4149–4155 (1994).
Lepri, et al., "Effect of Low Molecular Weight Heparan Sulphate on Angiogenesis in the Rat Cornea After Chemical Cauterization" *J. Ocular Pharmacol.* 10:273–280 (1994).

(List continued on next page.)

Primary Examiner—Sean McGarry
Assistant Examiner—Janet L Epps-Ford
(74) Attorney, Agent, or Firm—McDonnell Boehnen Hulbert & Berghoff LLP

(57) ABSTRACT

The present invention relates to nucleic acid molecules which modulate the synthesis, expression and/or stability of an mRNA encoding one or more receptors of vascular endothelial growth factor.

12 Claims, 22 Drawing Sheets

OTHER PUBLICATIONS

Matthews et al., "A receptor tyrosine kinase cDNA isolated from a population of enriched primitive hematopoietic cells and exhibiting close genetic linkage to c–kit" *Prior. Natl. Acad. Sci., USA*, 88:9026–9030 (1991).

Millauer et al., "Glioblastoma growth inhibited in vivo by a dominant–negative Flk–1 mutant" *Nature* 367:576–579 (1994).

Miller et al., "Vascular Endothelial Growth Factor/Vascular Permeability Factor Is Temporally and Spatially Correlated with Ocular Angiogenesis in a Primate Model" *Am. J. Pathol.* 145:574–584 (1994).

Neufeld et al., "Vascular Endothelial Growth Factor and its Receptors" *Prog. Growth Factor Res.* 5:89–97 (1994).

O'Reilly et al., "Angiostatin: A Novel Angiogenesis Inhibitor That Mediates the Suppression of Metastases by a Lewis Lung Carcinoma" *Cell* 79:315–328 (1994).

Ormerod et al., "Effects of Altering the Eicosanoid Precursor Pool on Neovascularization and Inflammation in the Alkali–burned Rabbit Cornea" *Am. J. Pathol.* 137:1243–1252 (1990).

Pandey et al., "Role of B61, the Ligand for the Eck Receptor Tyrosine Kinase, in TNF–α—Induced Angiogenesis" *Science* 268:567–569 (1995).

Passaniti et al., "Methods in Labortory Investigation, A simple, Quantitative Method of Assessing Angiogenesis and Antiangiogenic Agents Using Reconstituted Basement Membrane, Heparin, and Fibroblast Growth Factor" *Lab. Invest.* 67: 519–528 (1992).

Pierce et al., "Vascular endothelial growth factor/vascular permeability factor expression ina mouse model of retinal neovascularization" *Proc. Natl. Acad. SCi. USA.* 92:905–909 (1995).

Plouët et al., "Isolation and characterization of a newly identified endothelial cell mitogen produced by AtT–20 cells" *EMBO J.* 8:3801–3806 (1989).

Senger et al., "Vascular permeability factor (VPF, VEGF) in tumor biology" *Cancer and Metas. Rev.* 12:303–324 (1993).

Shalaby et al., "Failure of blood–island formation and vasculogenesis in Flk–1–deficient mice" *Nature* 376:62–66 (1995).

Shibuya et al., "Nucleotide sequence and expression of a novel human receptor–type tyrosine kinase gene (flt) closely related to the fms family" *Oncogene* 5:519–524 (1990).

Shweiki et al, "Patterns of Expression of Vascular Endothelial Growth Factor (VEGF) and VEGF Receptors in Mice Suggest a Role in Hormonally Regulated Angiogenesis" *J. Clin. Invest.* 91:2235–2243 (1993).

Takahashi et al., "Markedly Increased Amounts of Messenger RNAs for Vascular Endothelial Growth Factor and Placenta Growth Factor in Renal Cell Carcinoma Associated with Angiogenesis" *Cancer Res.* 54: 4233–4237 (1994).

Takeshita et al., "Therapeutic Angiogenesis, A single Intraarterial Bolus of Vascular Endothelial Growth Factor Augments Revascularization in a Rabbit Ischemic Hind Limb Model" *J. Clin. Invest.* 93:662–670 (1994).

Terman et al., "Identification of a new endothelial cell growth factor receptor tyrosine kinase" *Oncogene* 6:1677–1683 (1991).

Usman et al., "Exploiting the chemical synthesis of RNA," *TIBS* 17:334–339 (1992).

Vaisman et al., "Characterization of the Receptors of Vascular Endothelial Growth Factor" *J. Bio. Chem.* 265:19461–19466 (1990).

Zieche et al., "Angiogenesis Can Be Stimulated or Repressed In vivo by a Change in GM3:GD3 Ganglioside Ratio" *Lab. Invest.* 67:711–715 (1992).

Beigelman et al., "Chemical Modification of Hammerhead Ribozymes," *J. Biol. Chem.* 270:25702–25708 (1995).

Carter, "Adeno–Associated Virus Vectors," *Curr. Opi. Biotech.* 3:533–539 (1992).

Chen et al., "Multitarget–Ribozyme Directed To Cleave at up to Nine Highly Conserved HIV–1 env RNA Regions Inhibits HIV–1 Replication Potential Effectiveness Against Most Presently Sequenced HIV–1 Isolates," *Nucleic Acids Research* 20:4581–4589 (1992).

Chowrira et al., "Extensive Phosphorotioate Substitution Yields Highly Active and Nuclease–Resistant Hairpin Ribozymes," *Nucleic Acids Res.*, 20:2835–2840 (1992).

Chowrira et al., "In Vitro and in Vivo Comparison of Hammerhead, Hairpin, and Hepatitis Delta Virus Self–Processing Ribozyme Cassettes," *J. Biol. Chem.* 269:25856–25864 (1994).

Collins et al., "Reaction Conditions and Kinetics of Self–Cleavage of a Ribozyme Derived From Neurospora VS RNA," *Biochemisry* 32:2795–2799 (1993).

Dropulic et al., "Functional Characterization of a U5 Ribozyme: Intracellular Suppression of Human Immunodeficiency Virus Type I Expression," *Journal of Virology*, 66:1432–1441 (1992).

Duval–Valentin et al., "Specific inhibition of transcription by triple helix–forming oligonucletides," *Proc. Natl. Acad. Sci. USA* 89:504 (1992).

Egholm et al., "PNA hybridizes to complementary oligonucleotides obeying the Watson–Crick hydrogen–bonding rules," *Nature* 365:566–568 (1993).

Elroy–Stein et al., "Cytoplasmic Expression System Based on Constitutive Synthesis of Bacteriophage T7 RNA Polymerase in Mammalian Cells," *Proc. Natl. Acad. Sci. USA* 87:6743–6747 (1990).

Folkman et al., "Angiogenesis," *J. Biol. Chem.* 267:10931–10934 (1992).

Folkman, "What is the Evidence that Tumors are Angiogenesis Dependent?" Journal of the National Cancer Institute 82:4–6 (1990).

Gao et al., "Cytoplasmic Expression of a Reporter Gene by Co–Delivery of T7 RNA Polymerase and T7 Promoter Sequence with Cationic Liposomes," *Nucleic Acids Res* 21:2867–2872 (1993).

Guerrier–Tekada et al., "The RNA Moiety of Ribonuclease P Is the Catalytic Subunit of the Enzyme," *Cell* 35:849–857 (1983).

Hampel et al., "Hairpin' Catalytic RNA Model: Evidence for Helices and Sequence Requirement for Substrate RNA," *Nucleic Acids Res.* 18:299 (1990).

Hampel et al., "RNA Catalytic Properties of the Mimimum a(–)sTRSV Sequence," *Biochemistry* 28:4929–4399 (1989).

Izant et al., "Constitutive and Conditional Suppression of Exogenous and Endogeneous Genes by Anti–Sense RNA," *Science* 229:345–352 (1985).

Jaeger et al., "Improved Predictions of Secondary Structures for RNA," *Proc. Natl. Acad. Sci. USA*, 86:7706–7710 (1989).

Jellinek et al., "Inhibition of Receptor Binding by High–Affinity RNA Ligands to Vascular Endothelial Growth Factor," *Biochemistry* 33:10450–10456 (1994).

Kashani–Sabet et al., "Reversal of the Malignant Phenotype by an Anti ras Ribozyme," *Antisense Research and Development.*, 2:3–15 (1992).

Kim et al., "Inhibition of vascular endothelial growth factor–induced angiogenesis suppresses tumour growth in vivo," *Nature* 362:841–844 (1993).

L'Huillier et al., "Cytoplasmic Delivery of Ribozymes Leads to Efficient Reduction in α–Lactalbumin mRNA Levels in C1271 Mouse," *EMBO J.* 11:4411–4418 (1992).

Lieber et al., "Stable High–Level Gene Expression in Mammalian Cells by T7 Phage RNA Polymerase," *Methods Enzymol.*, 217:47–66 (1993).

Lisziewics et al., "Inhibition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. USA* 90:8000–8004 (1993).

McGarry et al., "Inhibition of heat shock protein synthesis by heat–inducible antisense RNA," *Proc. Natl. Acad. Sci. USA* 83:399–403 (1986).

Millauer et al., "High Affinity VEGF Binding and Developmental Expression Suggest Flk–1 as a Major Regulator of Vasculogenesis and Angiogenesis," *Cell* 72:835–846 (1993).

Milligan et al., "Synthesis of Small RNAs Using T7 RNA Polymerase," *Methods Enzymol*, 180:51–62 (1989).

Ohkawa et al., "Activities of HIV–RNA Targeted Ribozymes Transcribed From a 'Shot–Gun' Type Ribozyme–trimming Plasmid," *Nucleic Acids Symp. Serv.*, 27:15–16 (1992).

Ojwang et al., "Inhibition of Human Immunodeficiency Virus Type 1 Expression by a Hairpin Ribozyme," *Proc. N atl. Acad. Sci. USA* 89:10802–10806 (1992).

Perrault et al., "Mixed Deoxyribo– and Ribo–Oligonucleotides with Catalytic Activity," *Nature* 344:565–567 (1990).

Perrotta et al., "Cleavage of Oligoribonucleotides by a Rybozyme Derived from the Hepatitis δ Virus RNA Sequence," *Biochemistry* 31:16–21 (1992).

Pieken et al., "Kinetic Characterication of Ribonuclease–Resistant 2'–Modified Hammerhead Ribozymes," *Science* 253:314–317 (1991).

Plate et al., "Vascular endothelial growth factor is potential tumor angiogenesis factor in human gilomas in vivo," *Nature* 359:845–848 (1992).

Rossi et al., "Ribozymes as Anti–HIV–1 Therapeutic Agents: Principles, Applications, and Problems," *Aids Research and Human Retroviruses* 8:183–189 (1992).

Sarver et al., "Ribozymes as Potential Anti–HIV–1 Therapeutic Agents," *Science* 247:1222–1225 (1990).

Saville et al., "A Site–Specific Self–Cleavage Reaction Performed by a Novel RNA In Neurospora Mitochondria," *Cell* 61:685–696 (1990).

Saville et al.,*Proc. Natl. Acad. Sci. USA* 88:8826–8830 (1991).

Scanlon et al., *Proc. Natl. Acad. Sci. USA* 88:10591–10595 (1991).

Scaringe et al., "Chemical synthesis of biologically active oligoribonucleotides using β–cyanoethyl protected ribonucleoside phosphoramidites," *Nucleic Acids Res.* 18:5433–5441 (1990).

Stein et al., "Antisense Oligonucleotides as Therapeutic Agents—Is the Bullet Really Magical?" *Science* 261:1004–1288 (1993).

Taira et al., "Construction of a novel RNA–transcript–trimming plasmid which can be used both in vitro in plce of run–off and (G)–free transcriptions and in vivo as multi–sequences transcription vectors," *Nucleic Acids Res.*, 19:5125–5130 (1991).

Thompson et al., "Improved accumulation and activity of ribozymes expressed from a tRNA–based RNA polymerase III promoter," *Nucleic Acids Res.* 23:2259–2268 (1995).

Torrence et al., "Targeting RNA for degradation with a (2'–5') oligoadenylate–antisense chimera," *Proc. Natl. Acad. Sci. USA* 90:1300–1304 (1993).

Usman et al., "Automated Chemical Synthesis of Long Oligoriibonucleotides Using 2'–O–Silylated Ribonycleoside 3'–O–Phosphoramidites on a Controlled–Pore Glass Support: Synthesis of a 43–Nucleotide Sequence Similar to the 3'–Half Molecule of a *Escherichia coli* Formylmethoionine tRNA," *J. Am. Chem. Soc.*, 109:7845–7854 (1987).

Usman et al., "Chemical modification of hammerhead Ribozymes: activity and nuclease resistance," *Nucleic Acids Symp. Ser.* 31:163–164 (1994).

Usman et al., "Exploiting the chemical synthesis of RNA" *TIBS.* 17:334–339 (1992).

Ventura et al., "Activation of HIV–Specific Ribozyme Activity by Self–Cleavage" *Nucleic Acids Res.*, 21:3249–3255 (1993).

Weerasinghe et al., "Resistance to Human Immunodeficiency Virus Type 1 (HIV–1) Infection in Human CD4+ Lymphocyte–Derived Cell Lines Conferred by Using Retroviral Vectors Expressing an HIV–1 RNA–Specific Ribozyme," *Journal of VIrology* 65:5531–5534 (1991).

Wincott et al., "Synthesis, deprotection, analysis and purification of RNA and ribozymes," *Nucleic Acids Research* 23:2677–2684 (1995).

Yu et al., "A Hairpin Ribozyme Inhibits Expression of Diverse Strains of Human Immunodeficiency Virus Type 1," *Proc. Natl. Acad. Sci. USA* 90:6340–6344 (1993).

Zabner et al., "Adenovirus–Mediated Gene Transfer Transiently Corrects the Chloride Transport Defect in Nasal Epithelia of Patients with Cystic Fibrosis," *Cell* 75:207–216 (1993).

Zhou et al., "Synthesis of Functional mRNA in Mammalian Cells by Bacteriophage T3 RNA Polymerase," *Mol. Cell. Biol.*, 10:4529–4537 (1990).

International Search Report, PCT/US02/17674, filed May 29, 2002.

Parry et al. 1999. "Bioactivity of anti–angiogenic ribozymes targeting Flt–1 and KDR mRNA," *Nucleic Acid Res.* 27:2569–77.

* cited by examiner

Figure 1: Hammerhead Ribozyme

Figure 2. Hammerhead Ribozyme Substrate Motifs

Figure 3: Hairpin Ribozyme

Figure 4: Hepatitis Delta Virus Ribozyme (SEQ ID NO 8219)

Figure 5. Neurospora vs Ribozyme

Figure 6
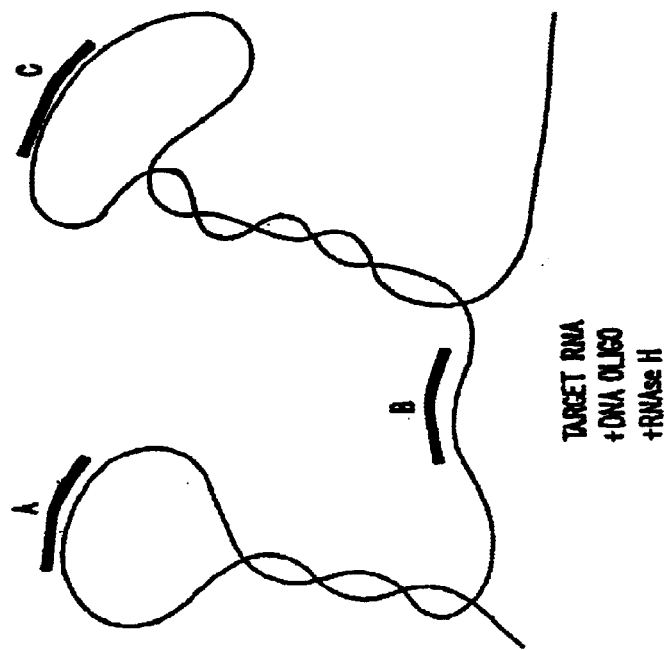
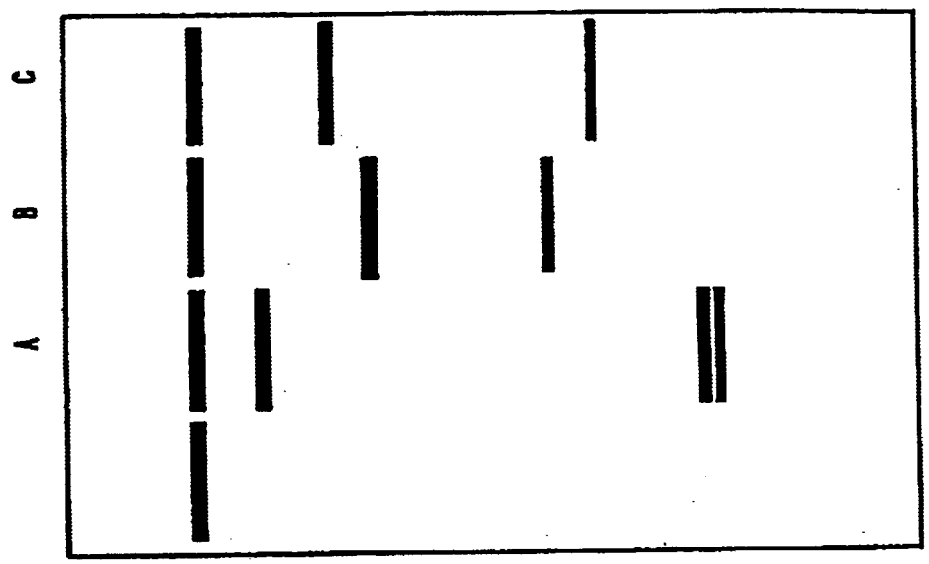

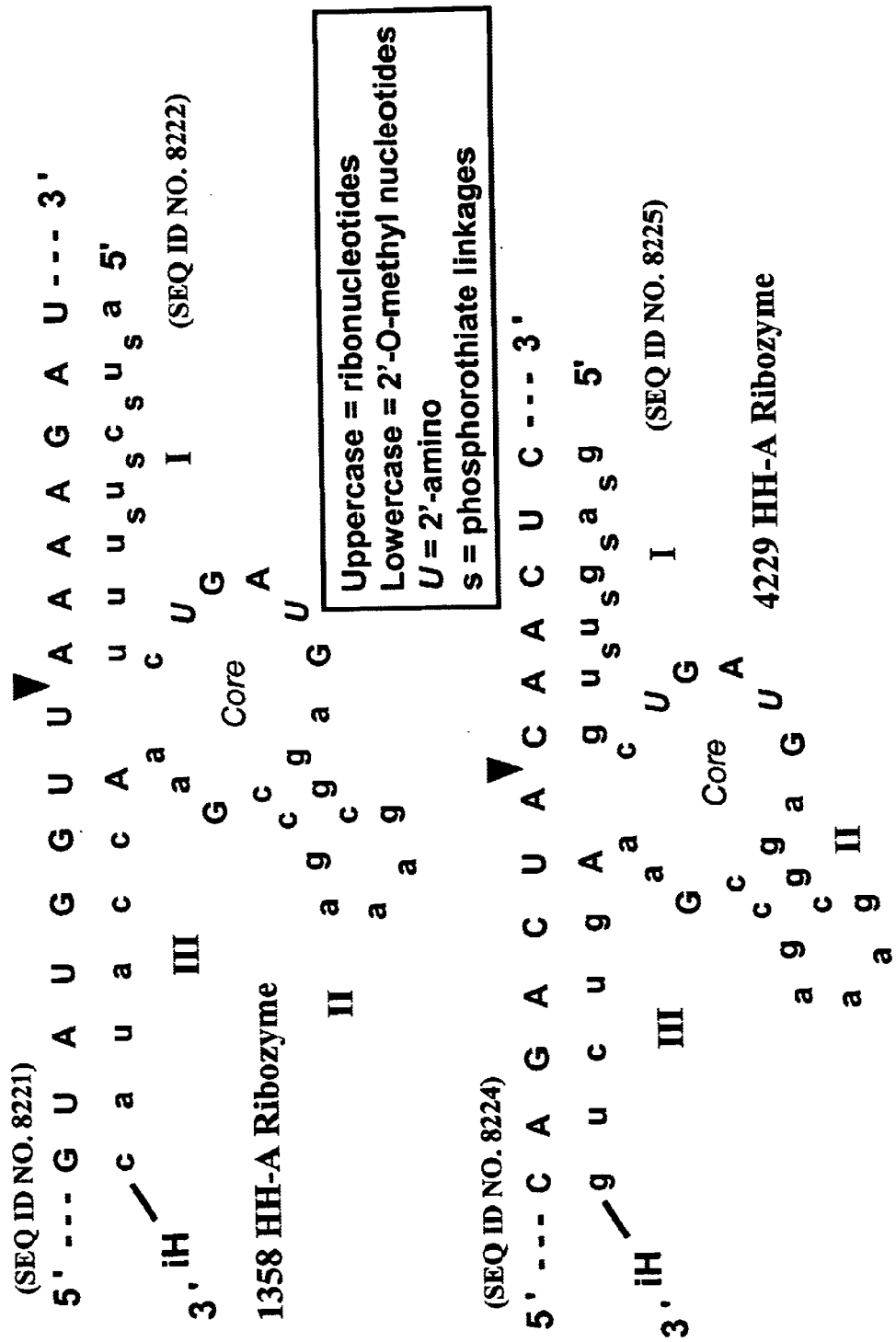

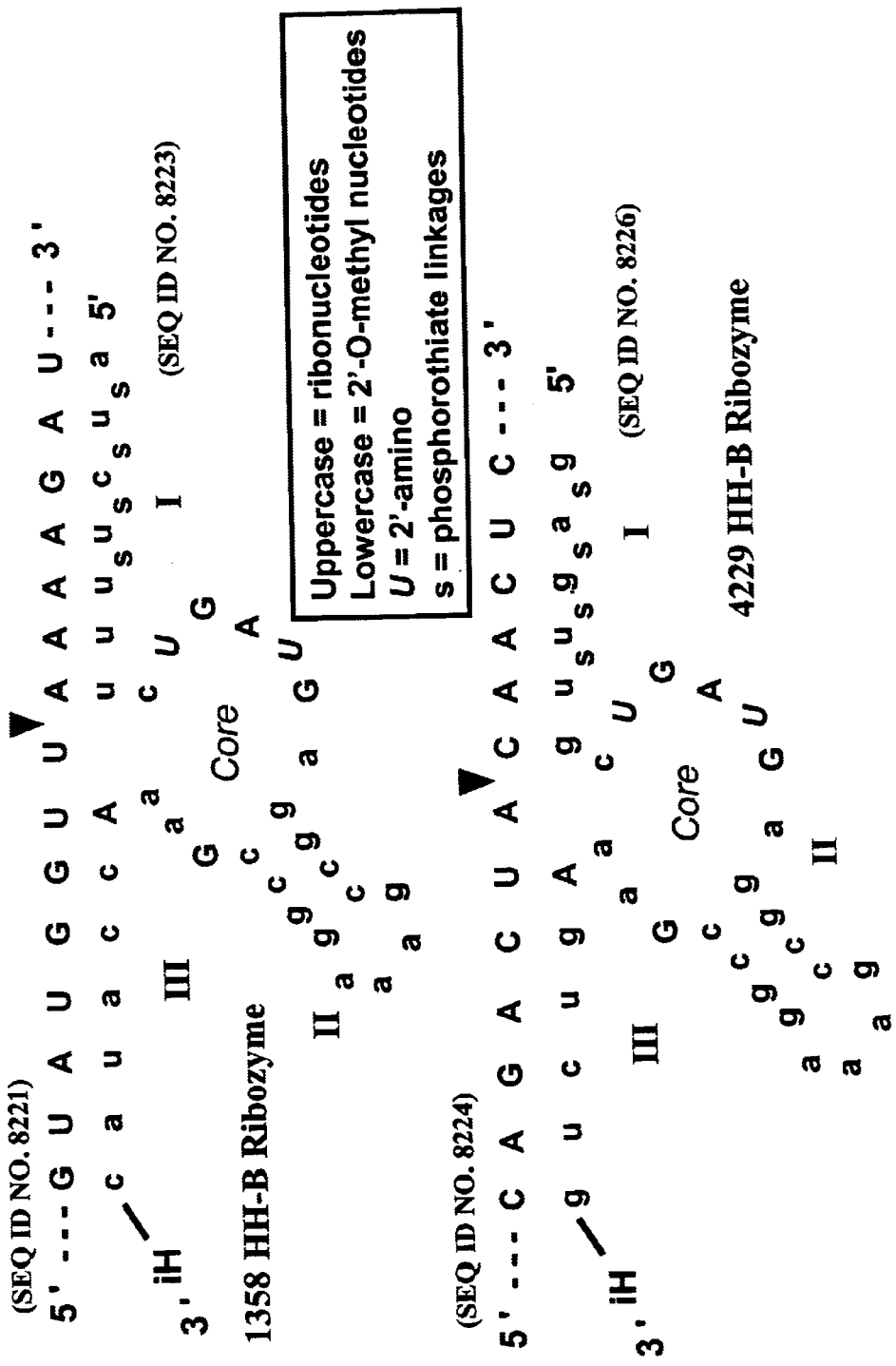
Figure 11A2: Hammerhead Ribozymes Targeted Against flt-1 RNA

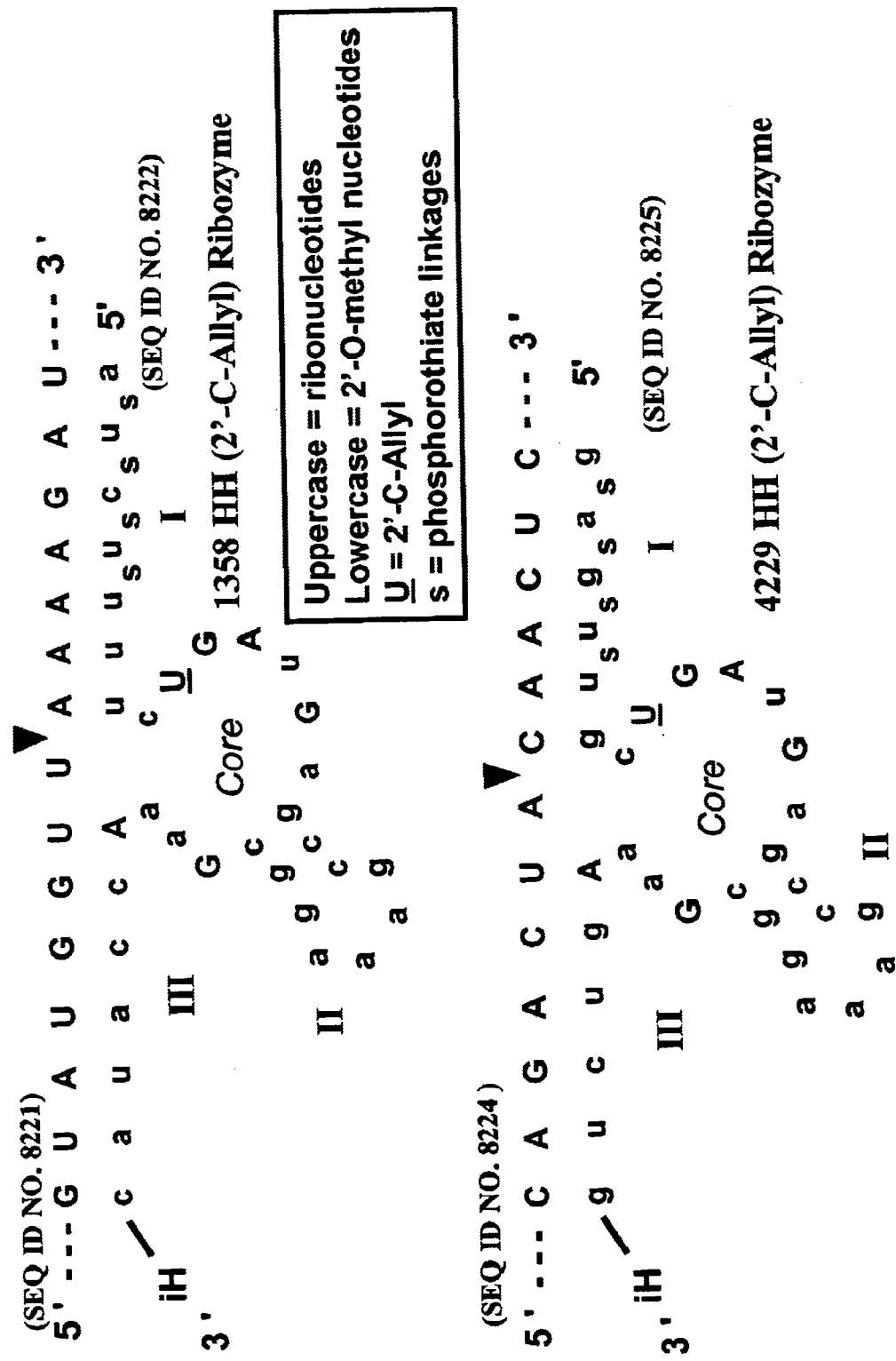
Figure 12A1: Hammerhead Ribozymes Targeted Against flt-1 RNA

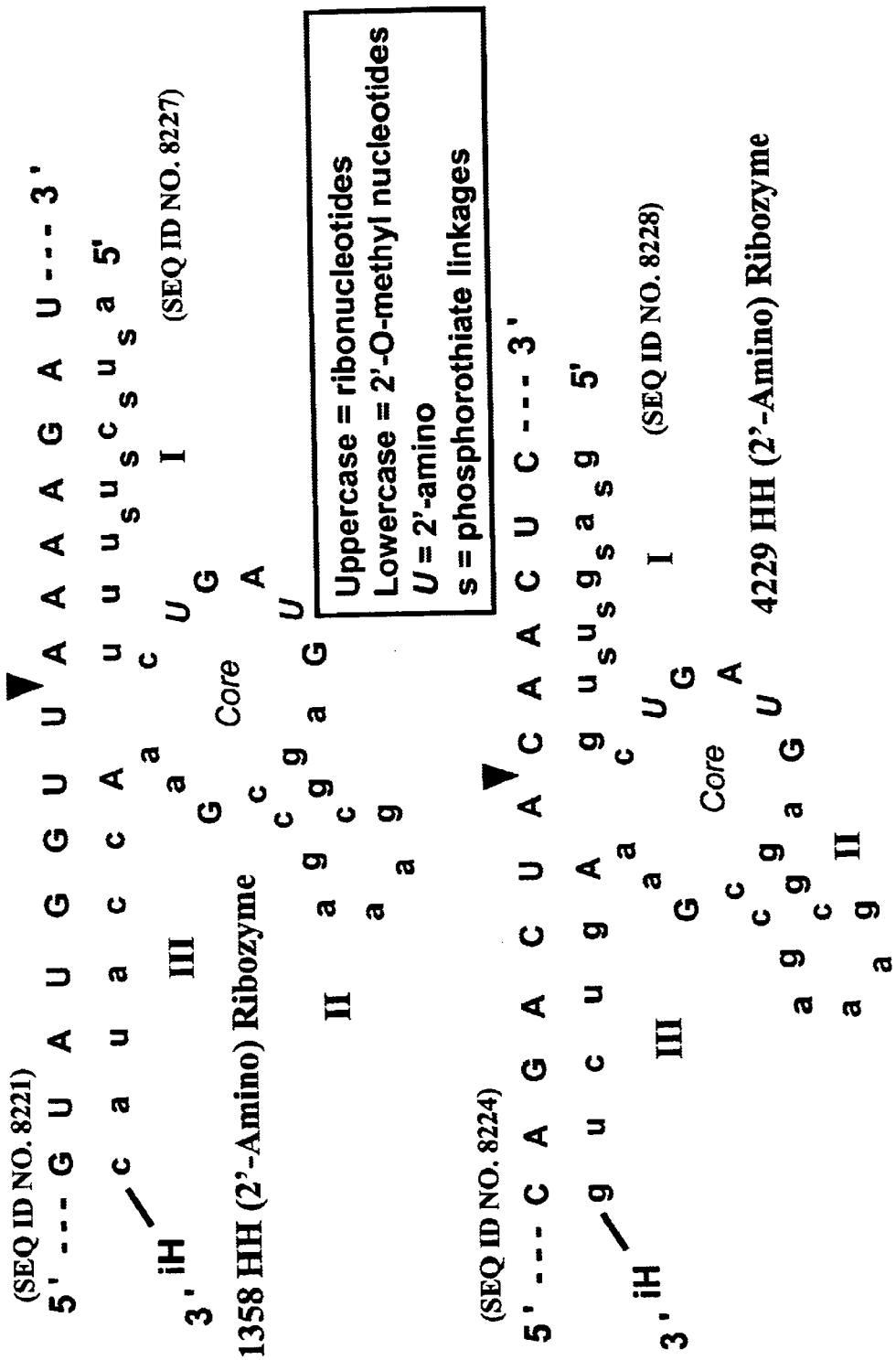
Figure 12A2: Hammerhead Ribozymes Targeted Against flt-1 RNA

METHOD AND REAGENT FOR THE TREATMENT OF DISEASES OR CONDITIONS RELATED TO LEVELS OF VASCULAR ENDOTHELIAL GROWTH FACTOR RECEPTOR

This application is a continuation of U.S. patent application Ser. No. 08/584,040, filed Jan. 11, 1996, now U.S. Pat. No. 6,346,398, which claims the benefit of U.S. Patent Application No. 60/005,974, filed Oct. 26, 1995, both of which are hereby incorporated by reference.

This application is a continuation-in-part of Pavco et al., U.S. Serial No. 60/005,974 all of which is hereby incorporated by reference herein (including drawings).

BACKGROUND OF THE INVENTION

The Sequence Listing file named "MBHB00,876-K SequenceListing.txt" (2,337,188 bytes in size) submitted on Compact Disc-Recordable (CD-R) medium ("010706_1627") in compliance with 37 C.F.R. §1.52(e) is incorporated herein by reference.

This invention relates to methods and reagents for the treatment of diseases or conditions relating to the levels of expression of vascular endothelial growth factor (VEGF) receptor(s).

The following is a discussion of relevant art, none of which is admitted to be prior art to the present invention.

VEGF, also referred to as vascular permeability factor (VPF) and vasculotropin, is a potent and highly specific mitogen of vascular endothelial cells (for a review see Ferrara, 1993 *Trends Cardiovas. Med.* 3, 244; Neufeld et al., 1994 *Prog. Growth Factor Res.* 5, 89). VEGF induced neovascularization is implicated in various pathological conditions such as tumor angiogenesis, proliferative diabetic retinopathy, hypoxia-induced angiogenesis, rheumatoid arthritis, psoriasis, wound healing and others.

VEGF, an endothelial cell-specific mitogen, is a 34–45 kDa glycoprotein with a wide range of activities that include promotion of angiogenesis, enhancement of vascular-permeability and others. VEGF belongs to the platelet-derived growth factor (PDGF) family of growth factors with approximately 18% homology with the A and B chain of PDGF at the amino acid level. Additionally, VEGF contains the eight conserved cysteine residues common to all growth factors belonging to the PDGF family (Neufeld et al., supra). VEGF protein is believed to exist predominantly as disulfide-linked homodimers; monomers of VEGF have been shown to be inactive (Plouet et al., 1989 *EMBO J.* 8, 3801).

VEGF exerts its influence on vascular endothelial cells by binding to specific high-affinity cell surface receptors. Covalent cross-linking experiments with $^{125}$I-labeled VEGF protein have led to the identification of three high molecular weight complexes of 225, 195 and 175 kDa presumed to be VEGF and VEGF receptor complexes (Vaisman et al., 1990 *J. Biol. Chem.* 265, 19461). Based on these studies VEGF-specific receptors of 180, 150 and 130 kDa molecular mass were predicted. In endothelial cells, receptors of 150 and the 130 kDa have been identified. The VEGF receptors belong to the superfamily of receptor tyrosine kinases (RTKs) characterized by a conserved cytoplasmic catalytic kinase domain and a hydrophylic kinase sequence. The extracellular domains of the VEGF receptors consist of seven immunoglobulin-like domains that are thought to be involved in VEGF binding functions.

The two most abundant and high-affinity receptors of VEGF are flt-1 (fms-like tyrosine kinase) cloned by Shibuya et al., 1990 *Oncogene* 5, 519 and KDR (kinase-insert-domain-containing receptor) cloned by Terman et al., 1991 *Oncogene* 6, 1677. The murine homolog of KDR, cloned by Mathews et al., 1991, *Proc. Natl. Acad. Sci.*, USA, 88, 9026, shares 85% amino acid homology with KDR and is termed as flk-1 (fet al liver kinase-1). Recently it has been shown that the high-affinity binding of VEGF to its receptors is modulated by cell surface-associated heparin and heparin-like molecules (Gitay-Goren et al., 1992 *J. Biol. Chem.* 267, 6093).

VEGF expression has been associated with several pathological states such as tumor angiogenesis, several forms of blindness, rheumatoid arthritis, psoriasis and others. Following is a brief summary of evidence supporting the involvement of VEGF in various diseases:

1) Tumor Angiogenesis

Increased levels of VEGF gene expression have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362,841 wherein, monoclonal antibodies against VEGF were successfully used to inhibit the growth of rhabdomyosarcoma glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576).

2) Ocular Diseses

Aiello et al., 1994 *New Engl. J. Med.* 331, 1480, showed that the ocular fluid, of a majority of patients suffering from diabetic retinopathy and other retinal disorders, contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases.

3) Psoriasis

Detmar et al., 1994 *J. Exp. Med.* 180, 1141 reported that VEGF and its receptors were over-expressed in psoriatic skin and psoriatic dermal microvessels, suggesting that VEGF plays a significant role in psoriasis.

4) Rheumatoid Arthritis

Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis.

In addition to the above data on pathological conditions involving excessive angiogenesis, a number of studies have demonstrated that VEGF is both necessary and sufficient for neovascularization. Takashita et al., 1995 *J. Clin. Invest.* 93, 662, demonstrated that a single injection of VEGF augmented collateral vessel development in a rabbit model of ischemia. VEGF also can induce neovascularization when injected into the cornea. Expression of the VEGF gene in CHO cells is sufficient to confer tumorigenic potential to the cells. Kim et al., supra and Millauer et al., supra used monoclonal antibodies against VEGF or a dominant negative form of flk-1 receptor to inhibit tumor-induced neovascularization.

During development, VEGF and its receptors are associated with regions of new vascular growth (Millauer et al. 1993 *Cell* 72, 835; Shalaby et al., 1993 *J. Clin. Invest.* 91, 2235). Furthermore. transgenic mice lacking either of the VEGF receptors are defective in blood vessel formation, infact these mouse do not survive; flk-1 appears to be required for differentiation of endothelial cells, while flt-1 appears to be required at later stages of vessel formation (Shalaby et al., 1995 Nature 376, 62; Fung et al., 1995 Nature 376, 66). Thus, these receptors must be present to properly signal endothelial cells or their precursors to respond to vascularization-promoting stimuli.

All of the conditions listed above, involve extensive vascularization. This hyper-stimulation of endothelial cells may be alleviated by VEGF antagonists. Thus most of the therapeutic efforts for the above conditions have concentrated on finding inhibitors of the VEGF protein.

Kim et al., 1993 Nature 362, 841 have been successful in inhibiting VEGF-induced tumor growth and angiogenesis in nude mice by treating the mice with VEGF-specific monoclonal antibody.

Koch et al., 1994 J. Immunol. 152, 4149 showed that the mitogenic activity of microvascular endothelial cells found in rheumatoid arthritis (RA) synovial tissue explants and the chemotactic property of endothelial cells from RA synovial fluid can be neutralized significantly by treatment with VEGF-specific antibodies.

Ullrich et al., International PCT Publication No. WO 94/11499 and Millauer et al., 1994 Nature 367, 576 used a soluble form of flk-1 receptor (dominant-negative mutant) to prevent VEGF-mediated tumor angiogenesis in immunodeficient mice.

Kendall and Thomas, International PCT Publication No. WO 94/21679 describe the use of naturally occuring or recombinantly-engineered soluble forms of VEGF receptors to inhibit VEGF activity.

Robinson, International PCT Publication No. WO 95/04142 describes the use of antisense oligonucleotides targeted against VEGF RNA to inhibit VEGF expression.

Jellinek et al., 1994 Biochemistry 33, 10450 describe the use of VEGF-specific high-affinity RNA aptamers to inhibit the binding of VEGF to its receptors.

Rockwell and Goldstein, International PCT Publication No. WO 95/21868, describe the use of anti-VEGF receptor monoclonal antibodies to neutralize the the effect of VEGF on endothelial cells.

SUMMARY OF THE INVENTION

The invention features novel nucleic acid-based techniques [e.g., enzymatic nucleic acid molecules (ribozymes), antisense nucleic acids, 2–5A antisense chimeras, triplex DNA, antisense nucleic acids containing RNA cleaving chemical groups (Cook et al., U.S. Pat. No. 5,359,051)] and methods for their use to down regulate or inhibit the expression of receptors of VEGF (VEGF–R).

In a preferred embodiment, the invention features use of one or more of the nucleic acid-based techniques to inhibit the expression of flt-1 and/or flk-1/KDR receptors.

By "inhibit" it is meant that the activity of VEGF–R or level of mRNAs or equivalent RNAs encoding VEGF–R is reduced below that observed in the absence of the nucleic acid. In one embodiment, inhibition with ribozymes preferably is below that level observed in the presence of an enzymatically inactive RNA molecule that is able to bind to the same site on the mRNA, but is unable to cleave that RNA. In another embodiment, inhibition with antisense oligonucleotides is preferably below that level observed in the presence of for example, an oligonucleotide with scrambled sequence or with mismatches.

By "enzymatic nucleic acid molecule" it is meant an RNA molecule which has complementarity in a substrate binding region to a specified gene target, and also has an enzymatic activity which is active to specifically cleave target RNA. That is, the enzymatic RNA molecule is able to intermolecularly cleave RNA and thereby inactivate a target RNA molecule. This complementary regions allow sufficient hybridization of the enzymatic RNA molecule to the target RNA and thus permit cleavage. One hundred percent complementarity is preferred, but complementarity as low as 50–75%. may also be useful in this invention. By "equivalent" RNA to VEGF–R is meant to include those naturally occurring RNA molecules in various animals, including human, mice, rats, rabbits, primates and pigs.

By "antisense nucleic acid" it is meant a non-enzymatic nucleic acid molecule that binds to target RNA by means of RNA-RNA or RNA-DNA or RNA-PNA (protein nucleic acid; Egholm et al., 1993 Nature 365, 566) interactions and alters the activity of the target RNA (for a review see Stein and Cheng, 1993 Science 261, 1004).

By "2–5A antisense chimera" it is meant, an antisense oligonucleotide containing a 5' phosphorylated 2'-5'-linked adenylate residues. These chimeras bind to target RNA in a sequence-specific manner and activate a cellular 2–5A-dependent ribonuclease which, in turn, cleaves the target RNA (Torrence et al., 1993 Proc. Natl. Acad. Sci. USA 90, 1300).

By "triplex DNA" it is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 Proc. Natl. Acad. Sci. USA 89, 504).

By "gene" it is meant a nucleic acid that encodes an RNA.

By "complementarity" it is meant a nucleic acid that can form hydrogen bond(s) with other RNA sequence by either traditional Watson-Crick or other non-traditional types (for example, Hoogsteen type) of base-paired interactions.

Six basic varieties of naturally-occurring enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general. enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets. Thus, a single ribozyme molecule is able to cleave many molecules of target RNA. In addition, the ribozyme is a highly specific inhibitor of gene expression, with the specificity of inhibition depending not only on the base-pairing mechanism of binding to the target RNA, but also on the mechanism of target RNA cleavage. Single mismatches, or base-substitutions, near the site of cleavage can completely eliminate catalytic activity of a ribozyme.

Ribozymes that cleave the specified sites in VEGF–R mRNAs represent a novel therapeutic approach to treat tumor angiogenesis, ocular diseases, rhuematoid arthritis, psoriasis and others. Applicant indicates that ribozymes are able to inhibit the activity of VEGF-R (specifically flt-1 and flk-1/KDR) and that the catalytic activity of the ribozymes is required for their inhibitory effect. Those of ordinary skill in the art will find that it is clear from the examples described that other ribozymes that cleave VEGF-R mRNAs may be readily designed and are within the invention.

In preferred embodiments of this invention, the enzymatic nucleic acid molecule is formed in a hammerhead or hairpin motif, but may also be formed in the motif of a hepatitis delta virus, group I intron or RNaseP RNA (in association with an RNA guide sequence) or Neurospora VS RNA. Examples of such hammerhead motifs are described by Rossi et al., 1992, *AIDS Research and Human Retroviruses* 8, 183, of hairpin motifs by Hampel et al., EP0360257, Hampel and Tritz, 1989 *Biochemistry* 28, 4929, and Hampel et al., 1990 *Nucleic Acids Res.* 18, 299, and an example of the hepatitis delta virus motif is described by Perrotta and Been, 1992 *Biochemistry* 31, 16; of the RNaseP motif by Guerrier-Takada et al., 1983 *Cell* 35, 849, Neurospora VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemisty* 32, 2795–2799) and of the Group I intron by Cech et al., U.S. Pat. No. 4,987,071. These specific motifs are not limiting in the invention and those skilled in the art will recognize that all that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule.

In a preferred embodiment the invention provides a method for producing a class of enzymatic cleaving agents which exhibit a high degree of specificity for the RNA of a desired target. The enzymatic nucleic acid molecule is preferably targeted to a highly conserved sequence region of target mRNAs encoding VEGF-R proteins (specifically flt-1 and flk-1/KDR) such that specific treatment of a disease or condition can be provided with either one or several enzymatic nucleic acids. Such enzymatic nucleic acid molecules can be delivered exogenously to specific tissue or cellular targets as required. Alternatively, the ribozymes can be expressed from DNA and/or RNA vectors that are delivered to specific cells.

Synthesis of nucleic acids greater than 100 nucleotides in length is difficult using automated methods, and the therapeutic cost of such molecules is prohibitive. In this invention, small nucleic acid motifs (e.g., antisense oligonucleotides, hammerhead or the hairpin ribozymes) are used for exogenous delivery. The simple structure of these molecules increases the ability of the nucleic acid to invade targeted regions of the mRNA structure. However, these nucleic acid molecules can also be expressed within cells from eukaryotic promoters (e.g., Izant and Weintraub, 1985 *Science* 229, 345; McGarry and Lindquist, 1986 *Proc. Natl. Acad. Sci. USA* 83, 399; SullengerScanlon et al., 1991, *Proc. Natl. Acad. Sci. USA,* 88, 10591–5; Kashani-Sabet et al., 1992 *Antisense Res. Dev.,* 2, 3–15; Dropulic et al., 1992 *J. Virol,* 66, 1432–41: Weerasinghe et al., 1991 *J. Virol,* 65, 5531–4; Ojwang et al., 1992 *Proc. Natl. Acad. Sci. USA* 89, 10802–6; Chen et al., 1992 *Nucleic Acids Res.,* 20, 4581–9; Sarver et al., 1990 *Science* 247, 1222–1225; Thompson et al., 1995 *Nucleic Acids Res.* 23, 2259). Those skilled in the art realize that any nucleic acid can me expressed in eukaryotic cells from the appropriate DNA/RNA vector. The activity of such nucleic acids can be augmented by their release from the primary transcript by a ribozyme (Draper et al., PCT WO93/23569, and Sullivan et al., PCT WO94/02595, both hereby incorporated in their totality by reference herein; Ohkawa et al., 1992 *Nucleic Acids Symp. Ser.,* 27, 15–6; Taira et al., 1991, *Nucleic Acids Res.,* 19, 5125–30; Ventura et al., 1993 *Nucleic Acids Res.,* 21, 3249–55; Chowrira et al., 1994 *J. Biol. Chem.* 269, 25856).

Such nucleic acids are useful for the prevention of the diseases and conditions discussed above, and any other diseases or conditions that are related to the levels of VEGF-R(specifically flt-1 and flk-1/KDR) in a cell or tissue.

By "related" is meant that the reduction of VEGF-R (specifically flt-1 and flk-1/KDR) RNA levels and thus reduction in the level of the respective protein will relieve, to some extent, the symptoms of the disease or condition.

Ribozymes are added directly, or can be complexed with cationic lipids, packaged within liposomes, or otherwise delivered to target cells or tissues. The nucleic acid or nucleic acid complexes can be locally administered to relevant tissues ex vivo, or in vivo through injection, infusion pump or stent, with or without their incorporation in biopolymers. In preferred embodiments, the ribozymes have binding arms which are complementary to the sequences in Tables II to IX. Examples of such ribozymes also are shown in Tables II to IX. Examples of such ribozymes consist essentially of sequences defined in these Tables. By "consists essentially of" is meant that the active ribozyme contains an enzymatic center equivalent to those in the examples, and binding arms able to bind mRNA such that cleavage at the target site occurs. Other sequences may be present which do not interfere with such cleavage.

In another aspect of the invention, ribozymes that cleave target RNA molecules and inhibit VEGF-R (specifically flt-1 and flk-1/KDR) activity are expressed from transcription units inserted into DNA or RNA vectors. The recombinant vectors are preferably DNA plasmids or viral vectors. Ribozyme expressing viral vectors could be constructed based on, but not limited to, adeno-associated virus, retrovirus, adenovirus, or alphavirus. Preferably, the recombinant vectors capable of expressing the ribozymes are delivered as described above, and persist in target cells. Alternatively, viral vectors may be used that provide for transient expression of ribozymes. Such vectors might be repeatedly administered as necessary. Once expressed, the ribozymes cleave the target mRNA. Delivery of ribozyme expressing vectors could be systemic, such as by intravenous or intramuscular administration, by administration to target cells ex-planted from the patient followed by reintroduction into the patient, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

DESCRIPTION OF THE PREFERRED EMBODIMENTS

First the drawings will be described briefly.

Drawings

Figure 1:
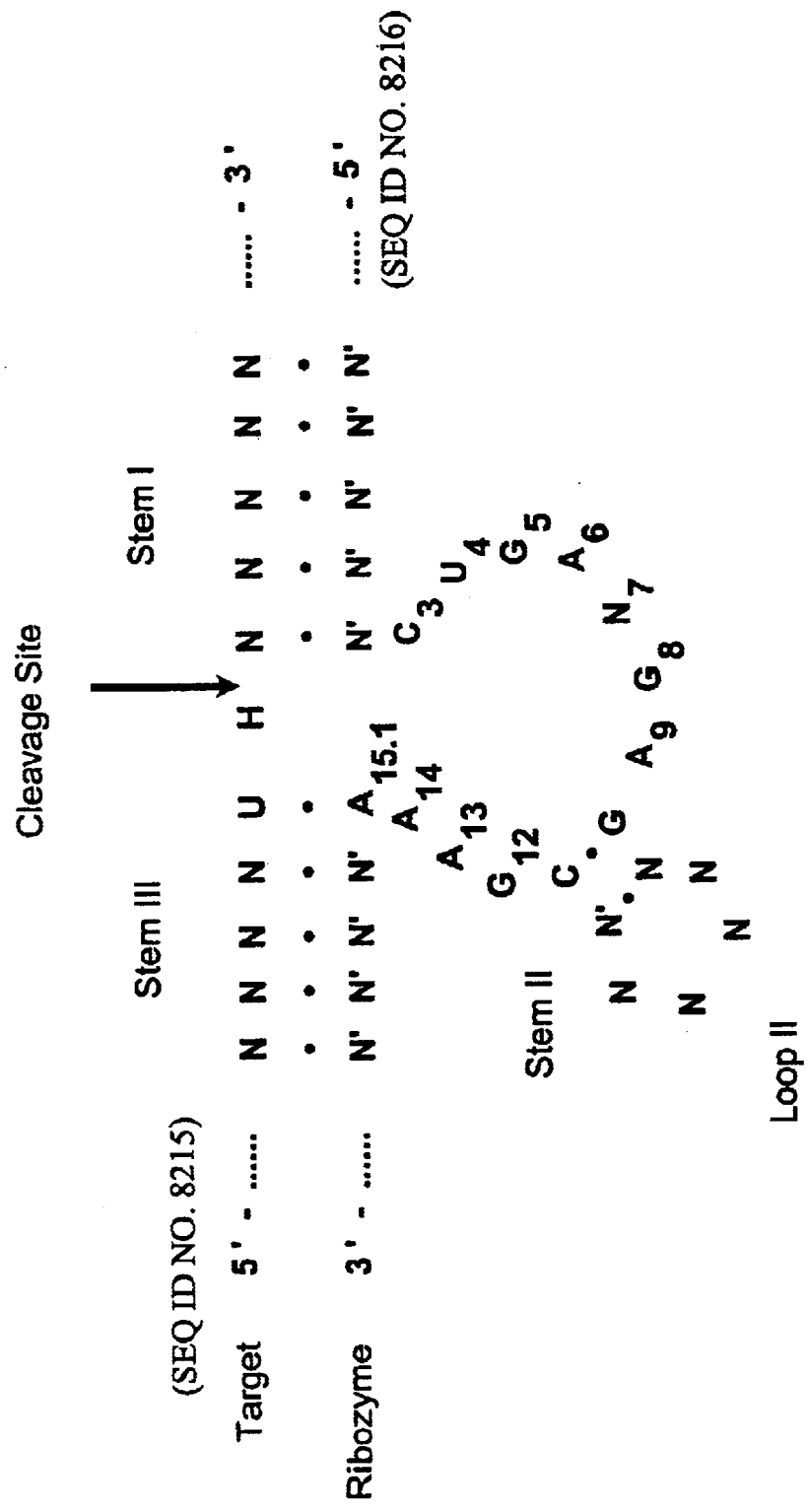
FIG. 1 is a diagrammatic representation of the hammerhead ribozyme domain known in the art. Stem II can be $\geq 2$ base-pair long. (SEQ ID NO: 8215–8216)
Figure 2:
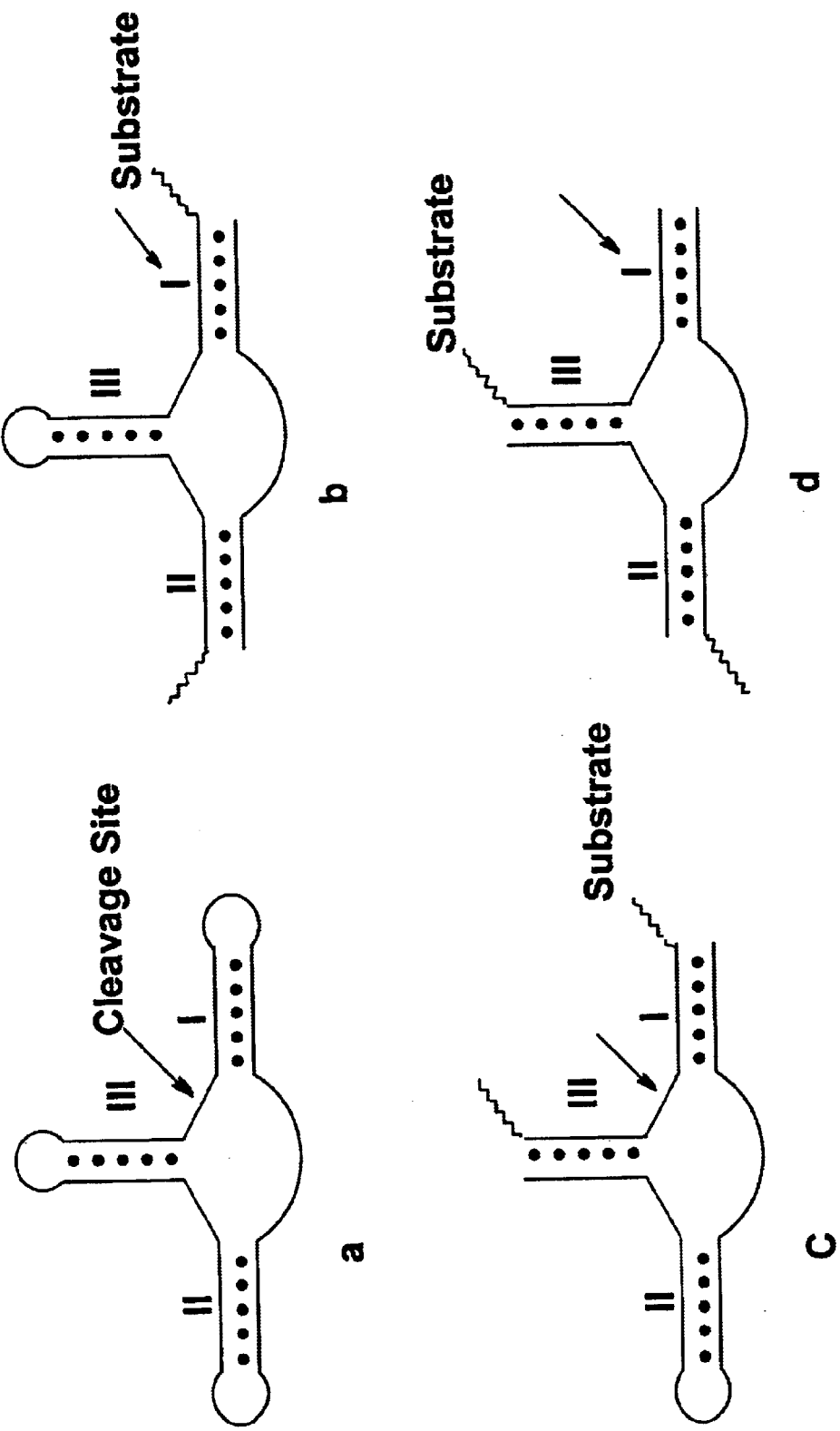
FIG. 2a is a diagrammatic representation of the hammerhead ribozyme domain known in the art.
FIG. 2b is a diagrammatic representation of the hammerhead ribozyme as divided by Uhlenbeck (1987, Nature, 327, 596–600) into a substrate and enzyme portion.
FIG. 2c is a similar diagram showing the hammerhead divided by Haseloff and Gerlach (1988, Nature, 334, 585–591) into two portion.

FIG. 2d is a similar diagram showing the hammerhead divided by Jeffries and Symons (1989, Nucl. Acids. Res., 17, 1371–1371) into two portions.

Figure 3:
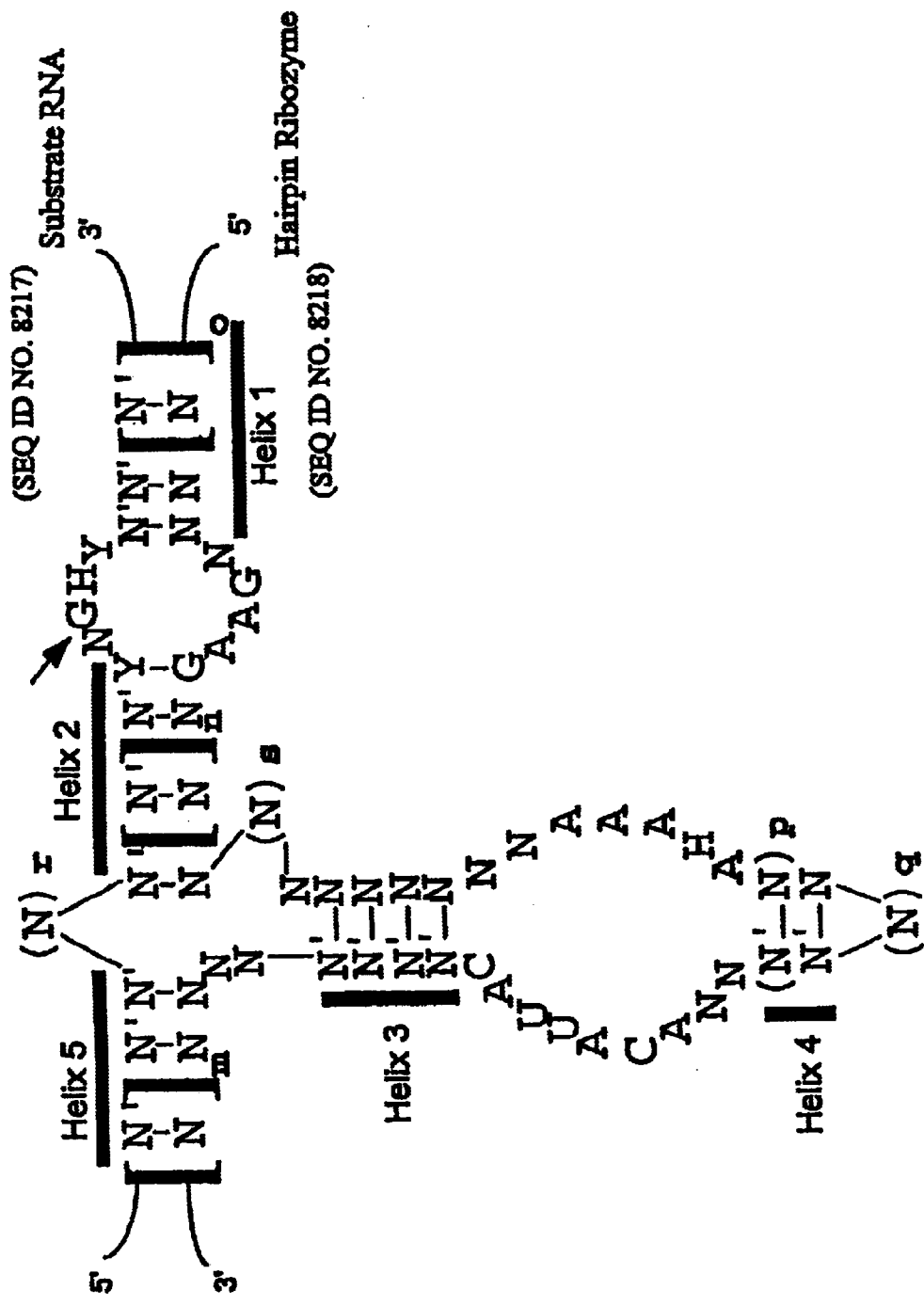

FIG. 3 is a diagramatic representation of the general structure of a hairpin ribozyme. Helix 2 (H2) is provided with a least 4 base pairs (i.e., n is 1, 2, 3 or 4) and helix 5 can be optionally provided of length 2 or more bases (preferably 3–20 bases. i.e., m is from 1–20 or more). Helix 2 and helix 5 may be covalently linked by one or more bases (i.e., r is ≧1 base). Helix 1, 4 or 5 may also be extended by 2 or more base pairs (e.g., 4–20 base pairs) to stabilize the ribozyme structure, and preferably is a protein binding site. In each instance, each N and N' independently is any normal or modified base, and each dash represents a potential base-pairing interaction. These nucleotides may be modified at the sugar, base or phosphate. Complete base-pairing is not required in the helices, but is preferred. Helix 1 and 4 can be of any size (i.e., o and p is each independently from 0 to any number, e.g., 20) as long as some base-pairing is maintained. Essential bases are shown as specific bases in the structure, but those in the art will recognize that one or more may be modified chemically (abasic, base, sugar and/or phosphate modifications) or replaced with another base without significant effect. Helix 4 can be formed from two separate molecules, i.e., without a connecting loop. The connecting loop when present may be a ribonucleotide with or without modifications to its base, sugar or phosphate. "q" is ≧2 bases. The connecting loop can also be replaced with a non-nucleotide linker molecule. H refers to bases A, U, or C. Y refers to pyrimidine bases. "_" refers to a covalent bond. (SEQ ID NO: 8217–8218)

Figure 4:
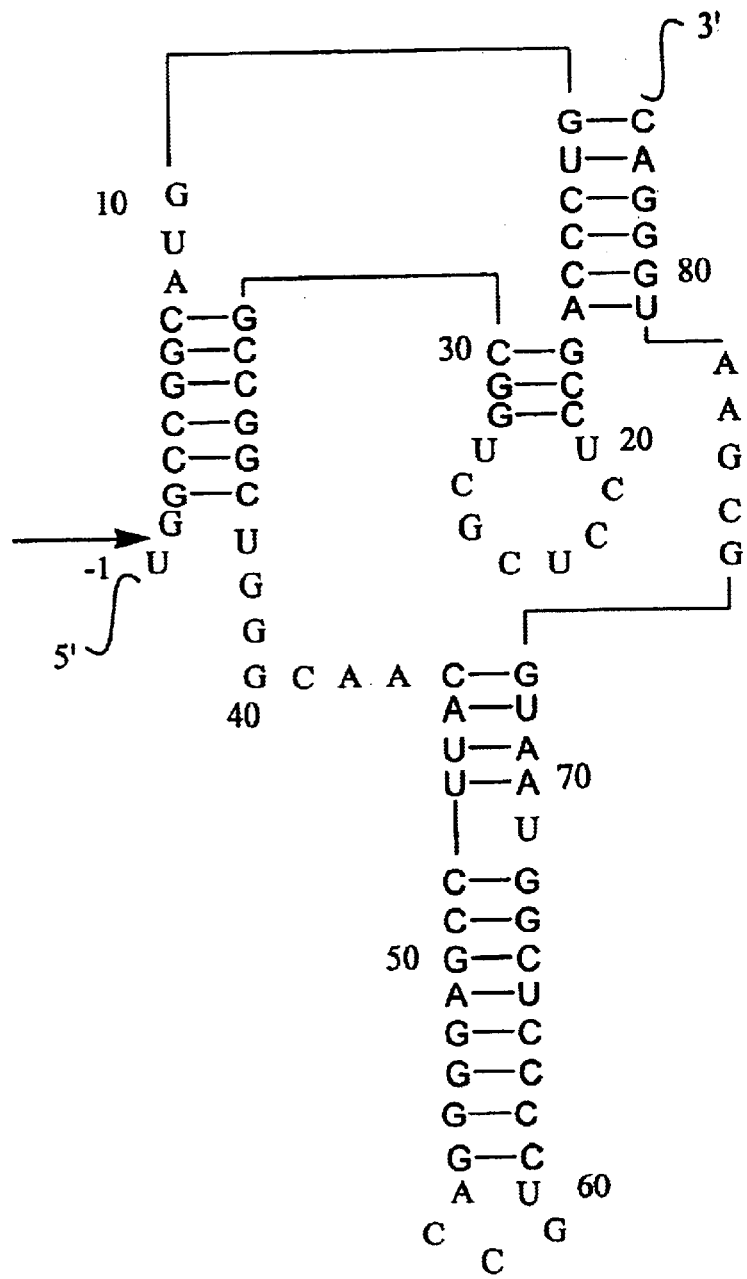

FIG. 4 is a representation of the general structure of the hepatitis delta virus ribozyme domain known in the art. (SEQ ID NO: 8219)

Figure 5:
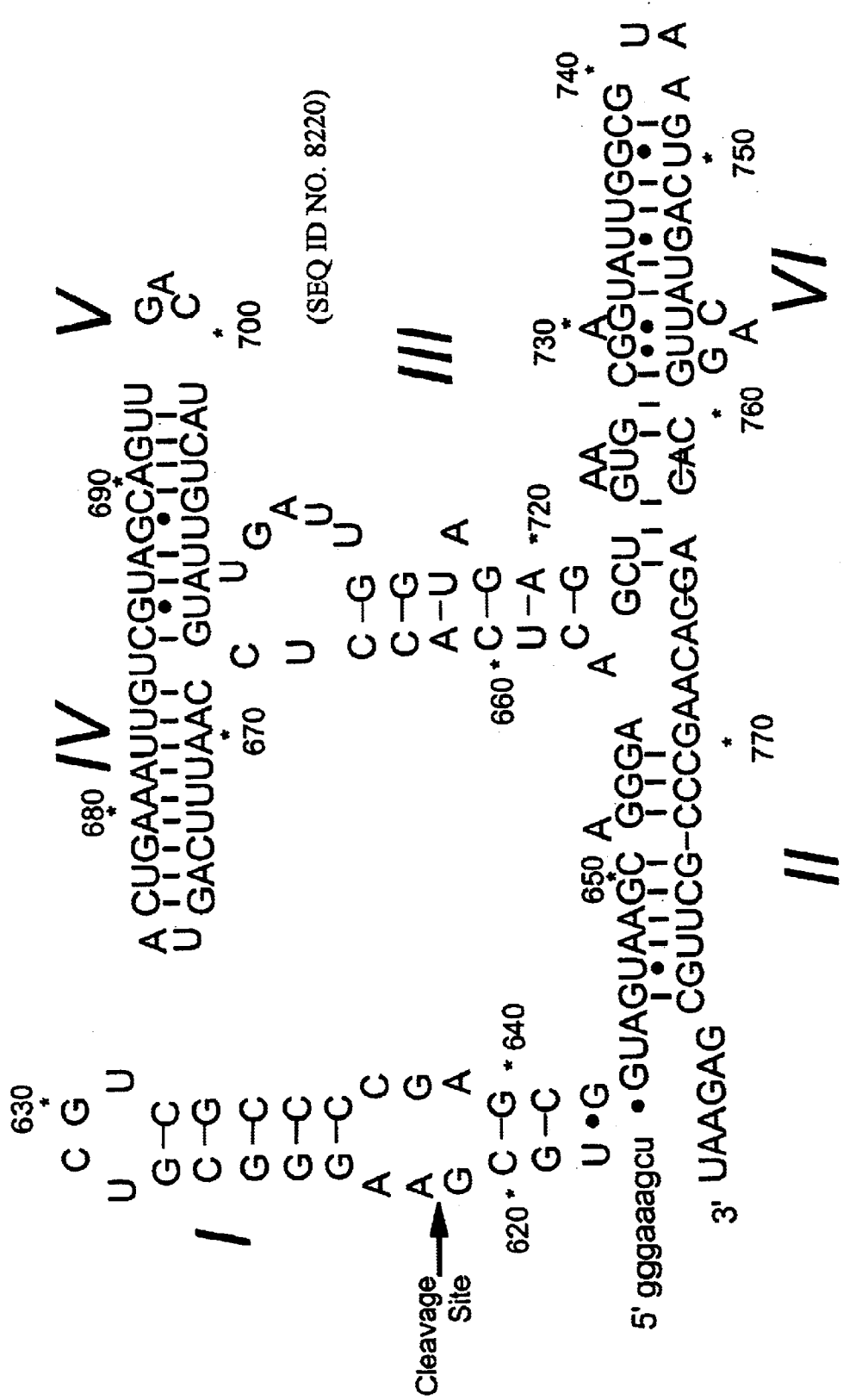

FIG. 5 is a representation of the general structure of the VS RNA ribozyme domain. (SEQ ID NO: 8220)

FIG. 6 is a schematic representation of an RNAseH accessibility assay. Specifically, the left side of FIG. 6 is a diagram of complementary DNA oligonucleotides bound to accessible sites on the target RNA. Complementary DNA oligonucleotides are represented by broad lines labeled A, B, and C. Target RNA is represented by the thin, twisted line. The right side of FIG. 6 is a schematic of a gel separation of uncut target RNA from a cleaved target RNA. Detection of target RNA is by autoradiography of body-labeled, T7 transcript. The bands common to each lane represent uncleaved target RNA; the bands unique to each lane represent the cleaved products.

Figure 7:
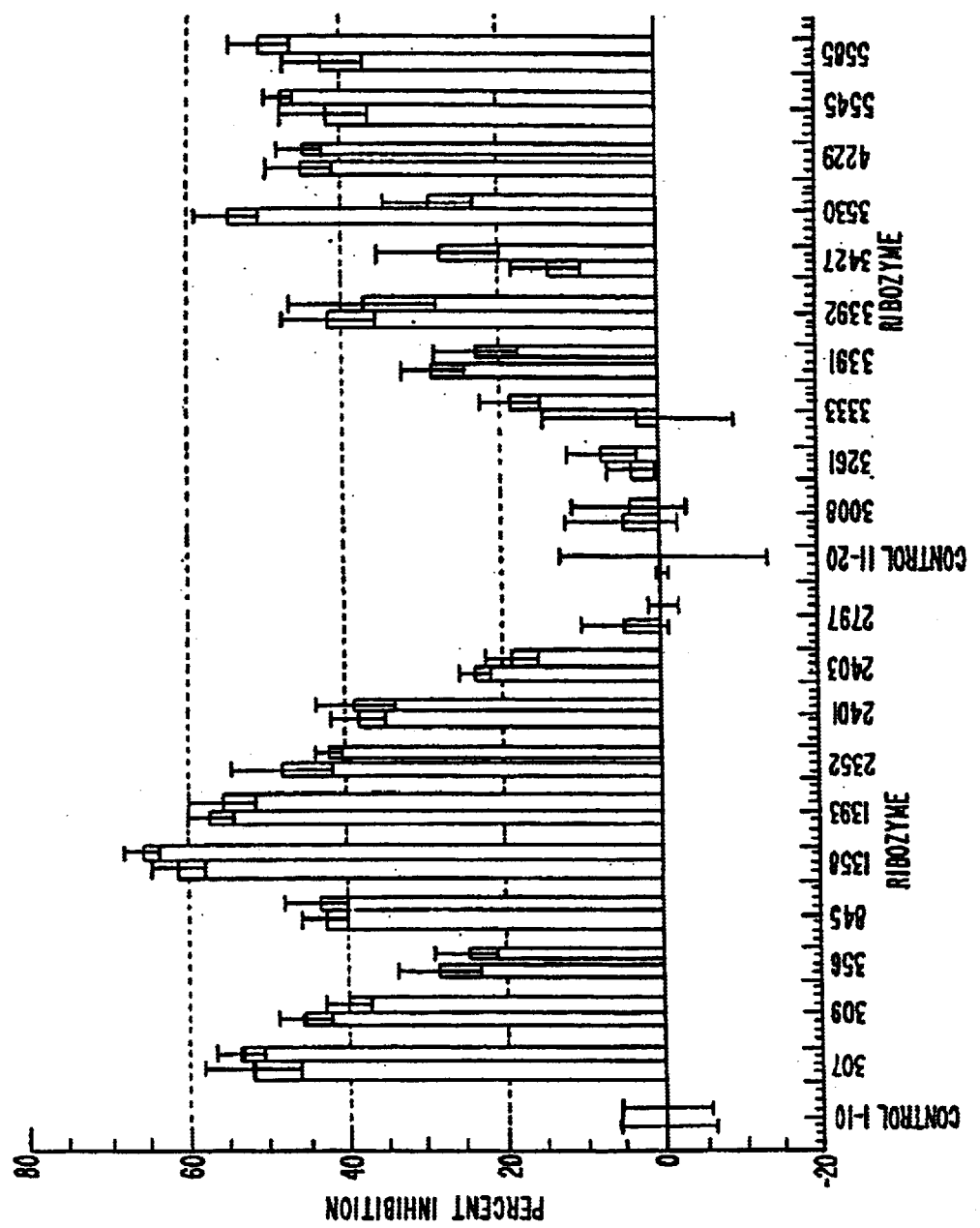

FIG. 7 shows the effect of hammerhead ribozymes targeted against flt-1 receptor on the binding of VEGF to the surface of human microvascular endothelial cells. Sequences of the ribozymes used are shown in Table II; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The results of two separate experiments are shown as separate bars for each set. Each bar represents the average of triplicate samples. The standard deviation is shown with error bars. For the flt-1 data, 500 nM ribozyme (3:1 charge ratio with LipofectAMINE®) was used. Control 1–10 is the control for ribozymes 307–2797, control 11–20 is the control for ribozymes 3008–5585. The Control 1–10 and Control 11–20 represent the treatment of cells with LipofectAMINE® alone without any ribozymes.

Figure 8:
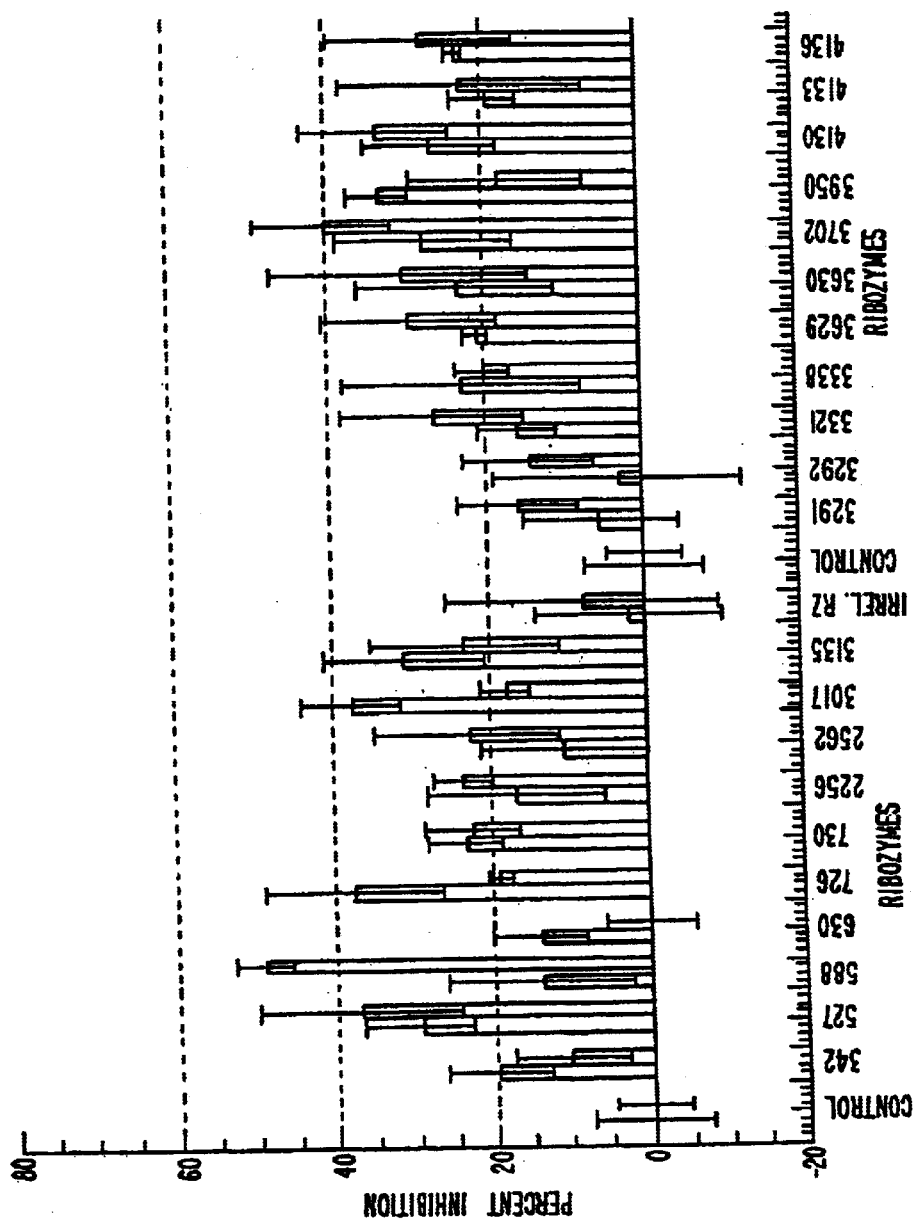

FIG. 8 shows the effect of hammerhead ribozymes targeted against KDR receptor on the binding of VEGA to KDR on the surface of human microvascular endothelial cells. Sequences of the ribozymes used are shown in Table IV; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The Control 1–10 and Control 11–20 represent the treatment of cells with LipofectAMINE®) alone without any ribozymes. Irrel. RZ, is a control experiment wherein the cells are treated with a non-KDR-targeted ribozyme complexed with Lipofectamine®. 200 nM ribozyme (3:1 charge ratio with LipofectAMINE(®) was used. In addition to the KDR-targeted ribozymes, the effect on VEGF binding of a ribozyme targeted to an irrelevant mRNA (irrel. RZ) is also shown. Because the affinity of KDR for VEGF is about 10-fold lower than the affinity of flt-1 for VEGF, a higher concentration of VEGF was used in the binding assay.

Figure 9:
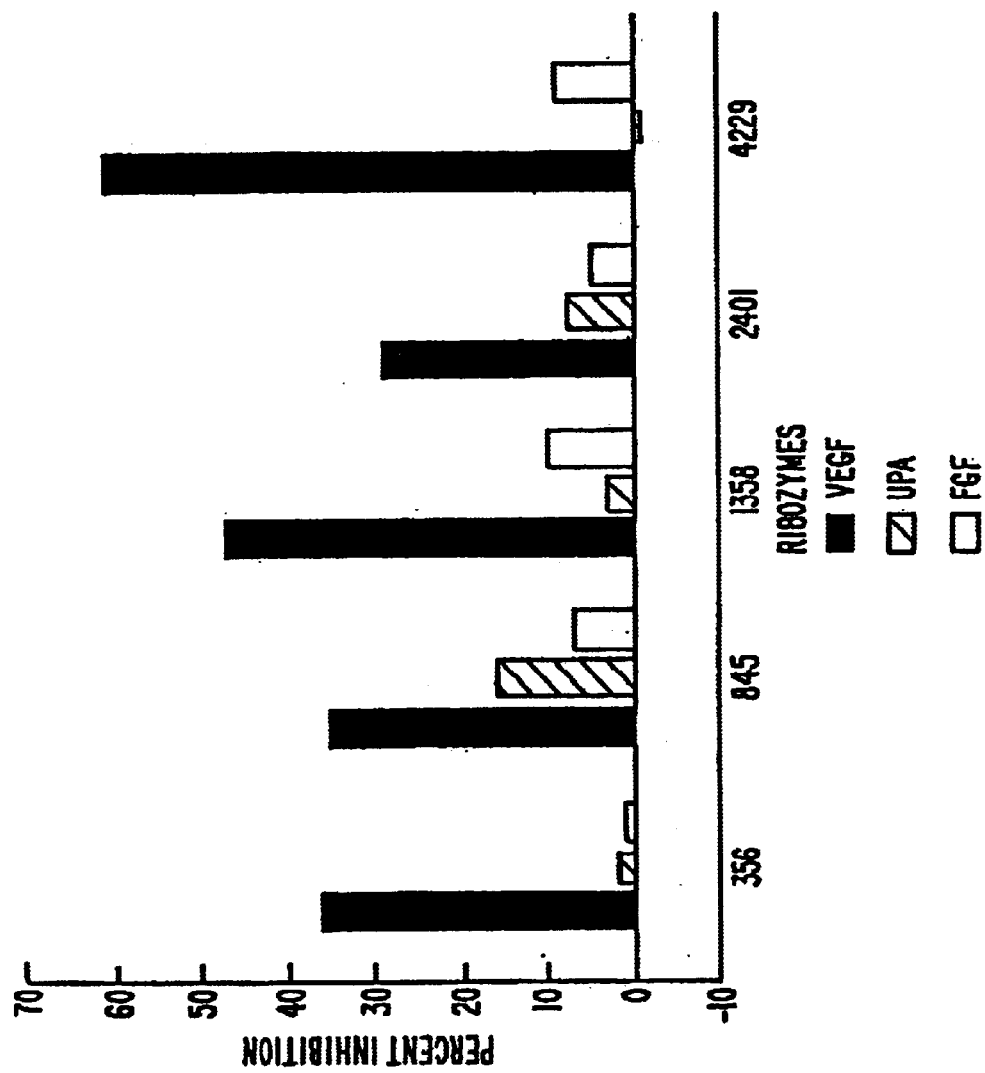

FIG. 9 shows the specificity of hammerhead ribozymes targeted against flt-1 receptor. Inhibition of the binding of VEGF, urokinase plasminogen activator (UPA) and fibroblast growth factor (FGF) to their corresponding receptors as a function of anti-FLT ribozymes is shown. The sequence and description of the ribozymes used are as described under FIG. 7 above. The average of triplicate samples is given; percent inhibition as calculated below.

Figure 10:
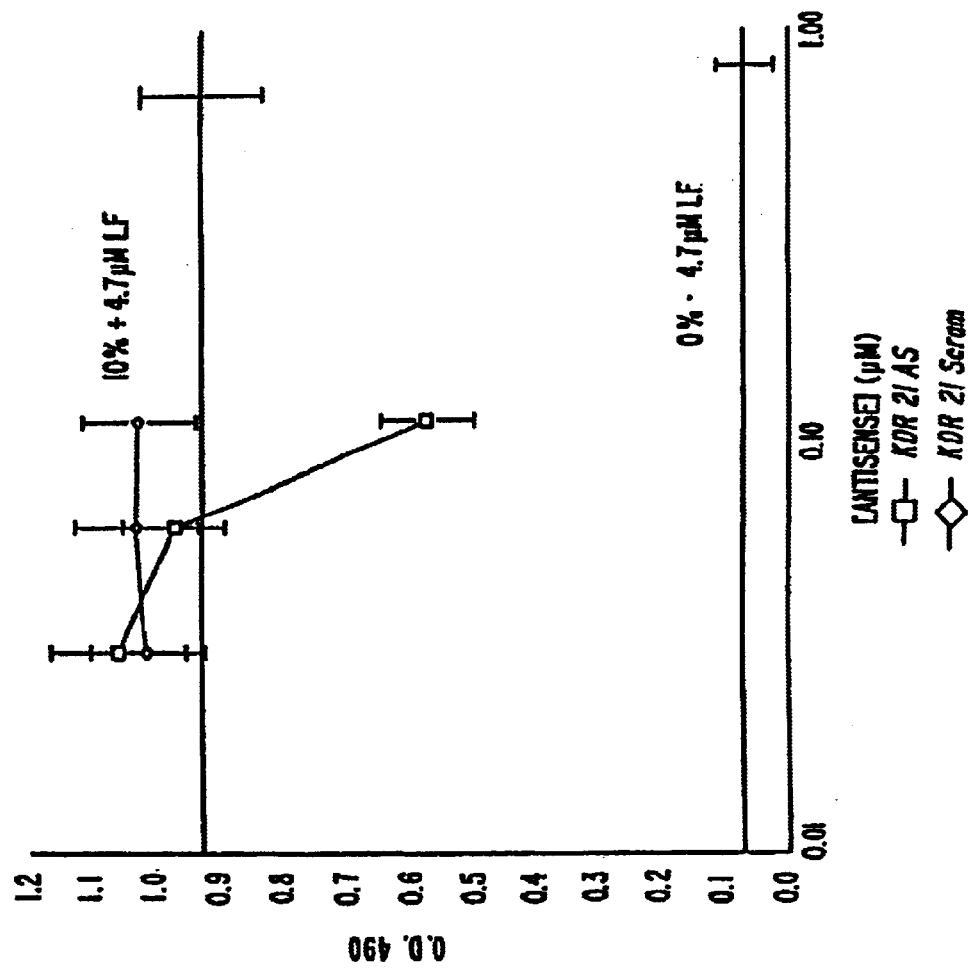

FIG. 10 shows the inhibition of the proliferation of Human aortic endothelial cells (HAEC) mediated by phosphorothioate antisense oligodeoxynucleotides targeted against human KDR receptor RNA. Cell proliferation (O.D. 490) as a function of antisense oligodeoxynucleotide concentration is shown. KDR 21AS represents a 21 nt phosphorothioate antisense oligodeoxynucleotide targeted against KDR RNA. KDR 21 Scram represents a 21 nt phosphorothioate oligodeoxynucleotide having a scrambled sequence. LF represents the lipid carrier Lipofectin.

FIGS. 11A1–11C shows in vitro cleavage of flt-1 RNA by hammerhead ribozymes. A1–A2) diagrammatic representation of hammerhead ribozymes targeted against flt-1 RNA. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose (designated as 3'-iH). 1358 HH-A and 4229 HH-A contain 3 base-paired stem II region. 1358 HH-B and 4229 HH-B contain 4 base-paired stem II region. B (SEQ ID NO: 8221–8222, 8224–8226) and C) show in vitro cleavage kinetics of HH ribozymes targeted against sites 1358 and 4229 within the flt-1 RNA.

FIGS. 12A1–12B shows inhibition of human microvascular endothelial cell proliferation mediated by anti-flt-1 hammerhead ribozymes. A) Diagrammatic representation of hammerhead (HH) ribozymes targeted against sites 1358 and 4229 within the the flt-1 RNA. B) Graphical representation of the inhibition of cell proliferation mediated by 1358HH and 4229HH ribozymes.(SEQ ID NO: 8221–8222, 8224–8225, 8228)

Figure 13:
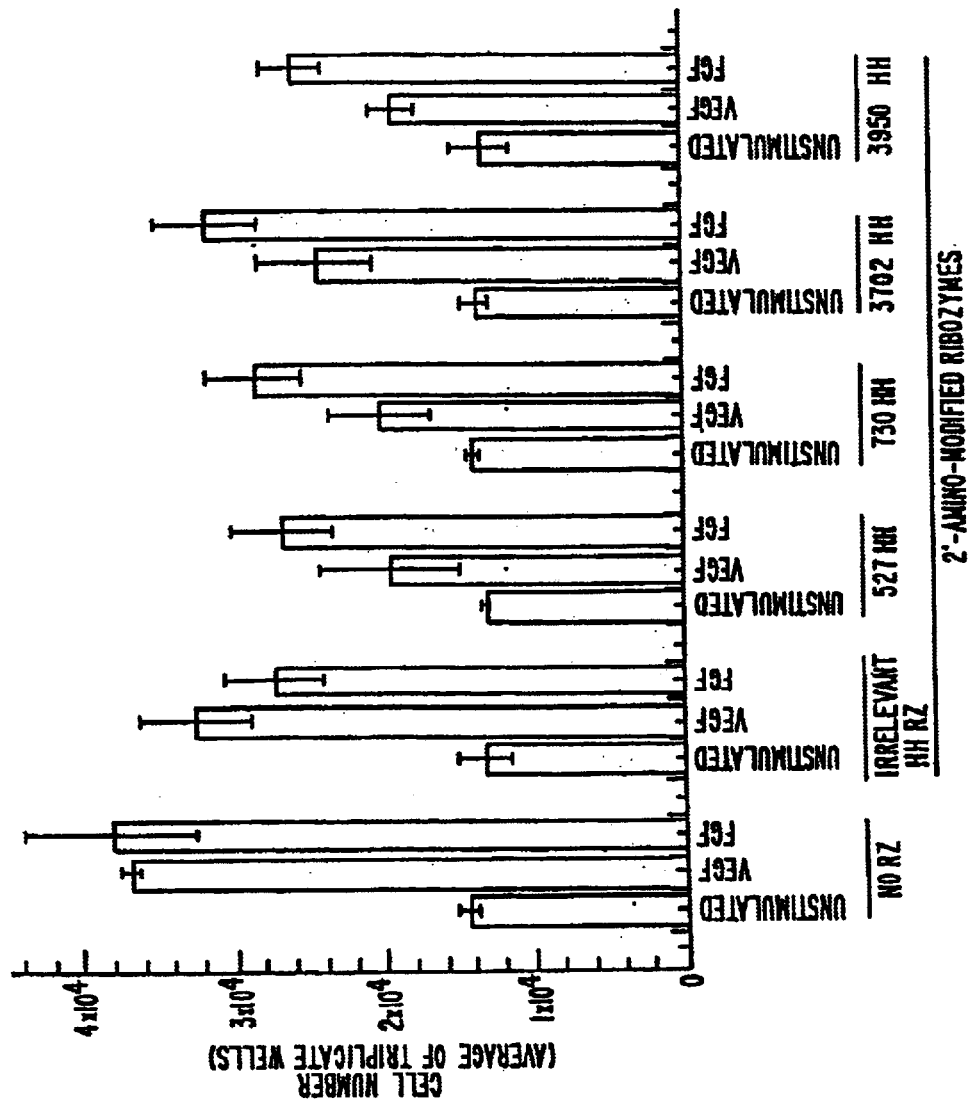

FIG. 13 shows inhibition of human microvascular endothelial cell proliferation mediated by anti-KDR hammerhead ribozymes. The figure is a graphical representation of the inhibition of cell proliferation mediated by hammerhead ribozymes targeted against sites 527, 730, 3702 and 3950 within the KDR RNA. Irrelevant HH RZ is a hammerhead ribozyme targeted to an irrelevant target. All of these ribozymes, including the Irrelevant HH RZ, were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 14:
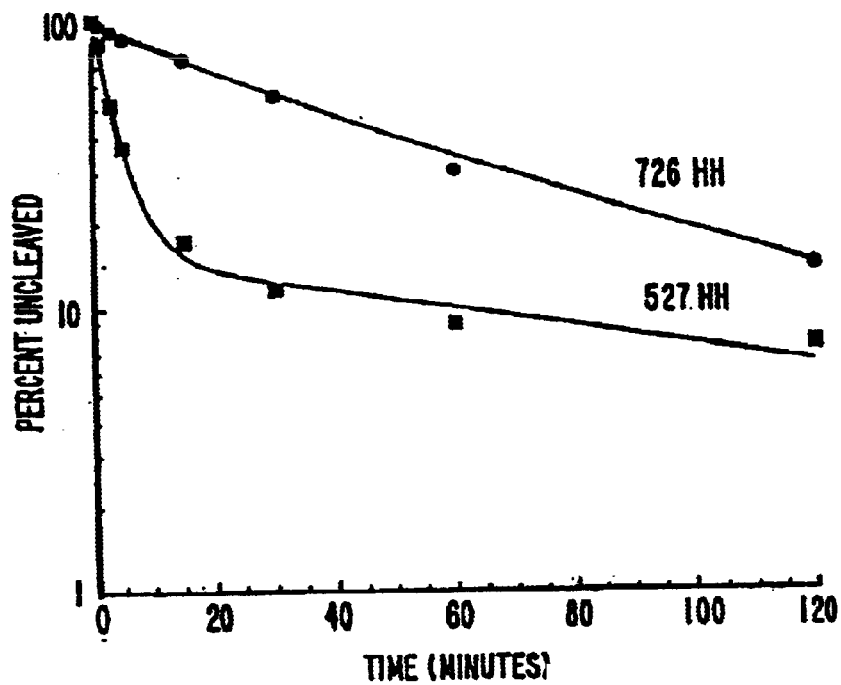

FIG. 14 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 726 HH and 527 HH contain 4 base-paired stem II region. Percent in vitro cleavage kinetics as a function of time of HH ribozymes targeted against sites 527 and 726 within the KDR RNA is shown.

Figure 15:
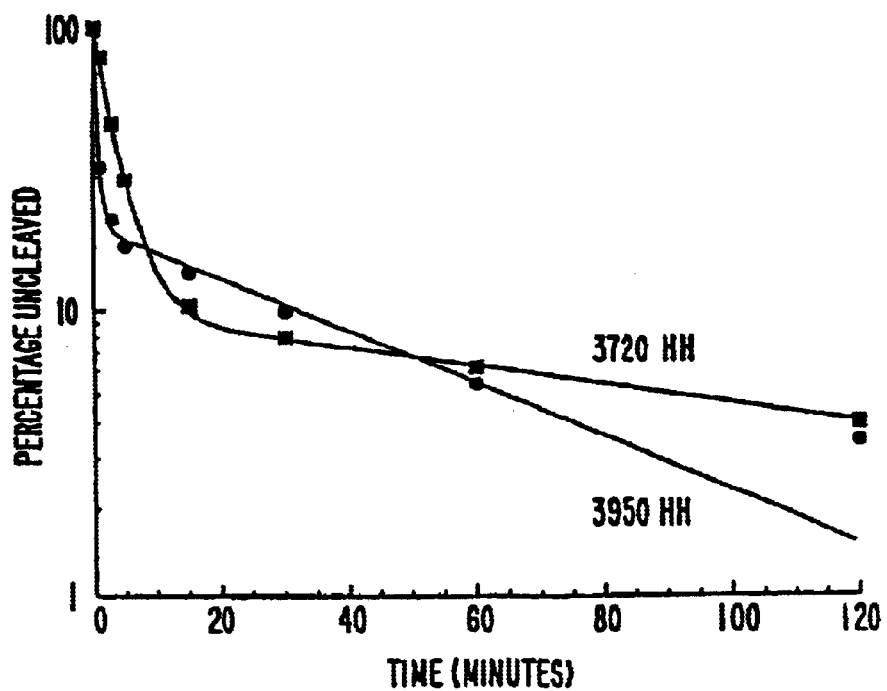

FIG. 15 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 3702 HH and 3950 HH contain 4 base-paired stem II region. Percent in vitro cleavage kinetics as a function of time of HH ribozymes targeted against sites 3702 and 3950 within the KDR RNA is shown.

Figure 16:
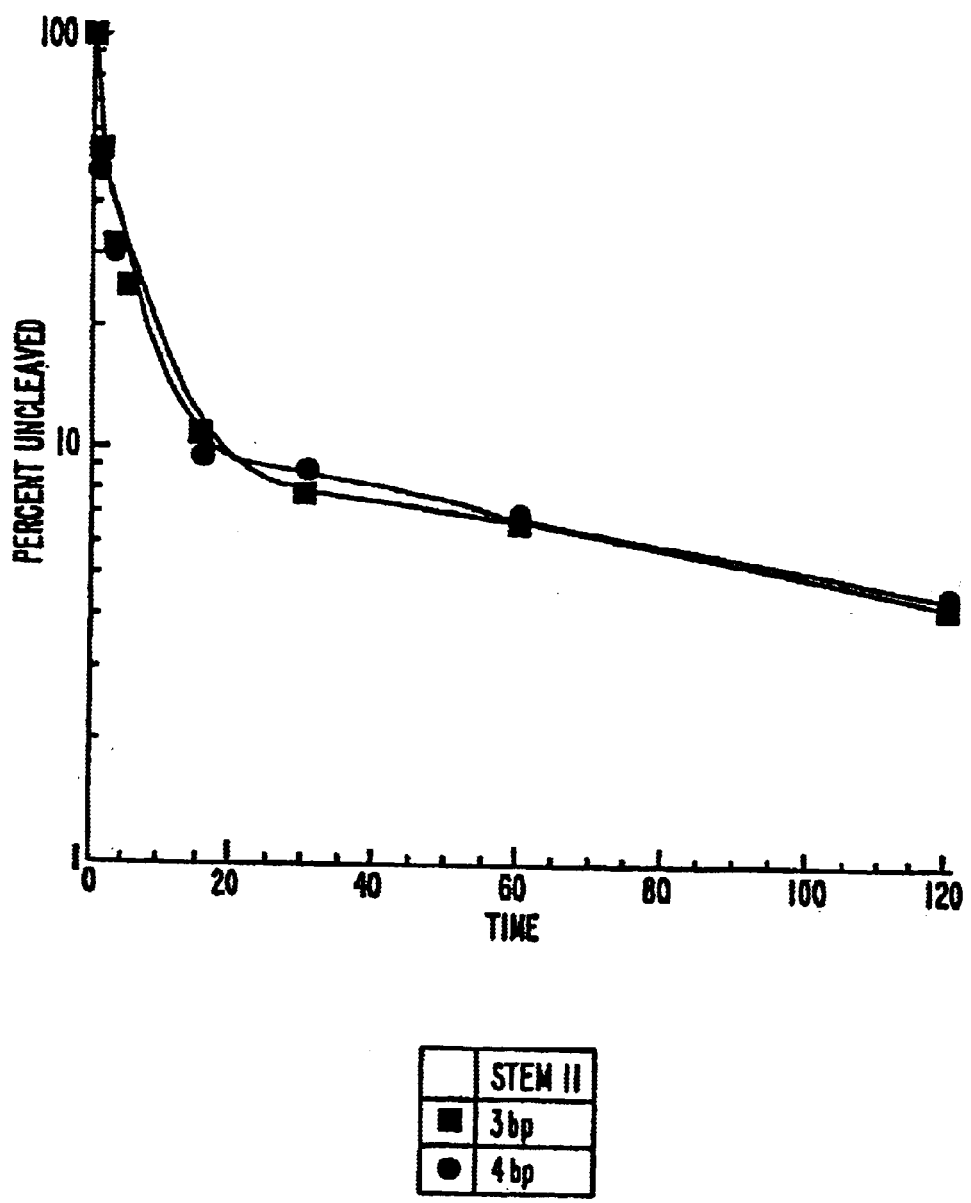

FIG. 16 shows in vitro cleavage of RNA by hammerhead ribozymes that are targeted to sites that are conserved between flt-1 and KDR RNA. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). FLT/KDR-I HH ribozyme was synthesized with either a 4 base-paired or a 3 base-paired stem II region. FLT/KDR-I HH can cleave site 3388 within flt-1 RNA and site 3151 within KDR RNA. Percent in vitro cleavage kinetics as a function of time of HH ribozymes targeted against sites 3702 and 3950 within the KDR RNA is shown.

Figure 17:
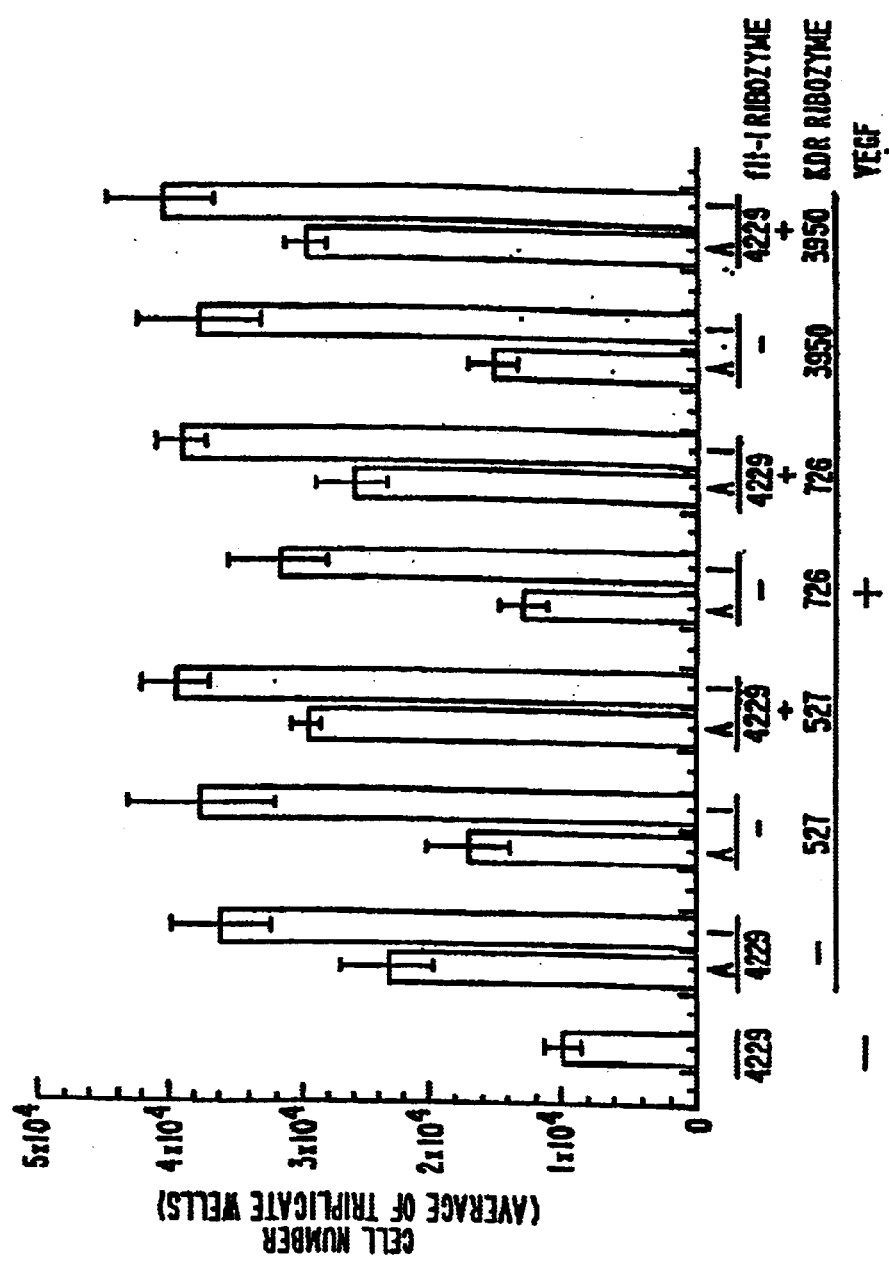

FIG. 17 shows inhibition of human microvascular endothelial cell proliferation mediated by anti-KDR and anti-flt-1 hammerhead ribozymes. The figure is a graphical representation of the inhibition of cell proliferation mediated by hammerhead ribozymes targeted against sites KDR sites –527, 726 or 3950 or flt-1 site 4229. The figure also shows enhanced inhibition of cell proliferation by a combination of flt-1 and KDR hammerhead ribozymes. 4229+527, indicates the treatment of cells with both the flt 4229 and the KDR 527 ribozymes. 4229+726, indicates the treatment of cells with both the flt 4229 and the KDR 726 ribozymes. 4229+3950, indicates the treatment of cells with both the flt 4229 and the KDR 3950 ribozymes. VEGF –, indicates the basal level of cell proliferation in the absence of VEGF. A, indicates catalytically active ribozyme; I, indicates catalytically inactive ribozyme. All of these ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 18:
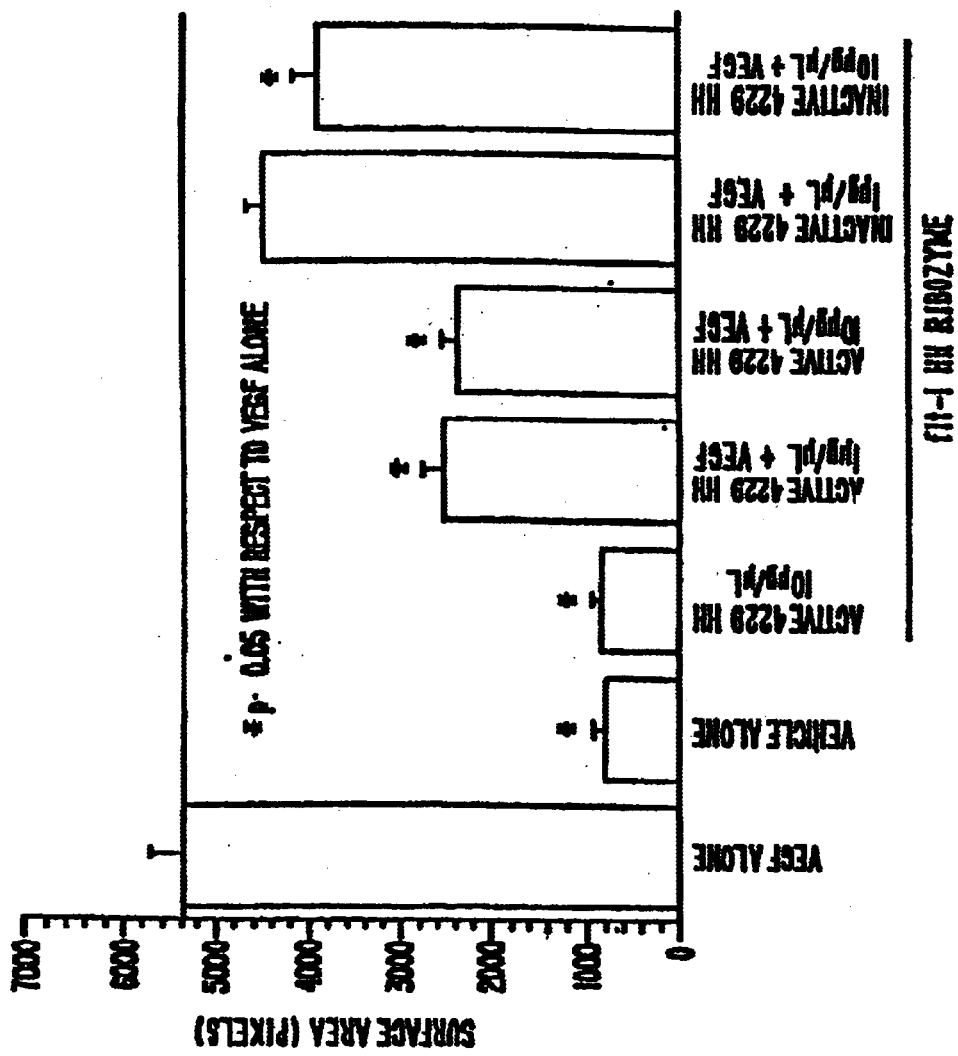

FIG. 18 shows the inhibition of VEGF-induced angiogenesis in rat cornea mediated by anti-flt-1 hammerhead ribozyme. All of these ribozymes were chemically modified such that the ribozyme consists of ribose residues at five positions; U4 position contains 2'-C-allyl modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH). A decrease in the Surface Area corresponds to a reduction in angiogenesis. VEGF alone, corresponds to treatment of the cornea with VEGF and no ribozymes. Vehicle alone, corresponds to the treatment of the cornea with the carrier alone and no VEGF. This control gives a basal level of Surface Area. Active 4229 HH, corresponds to the treatment of cornea with the flt-1 4229 HH ribozyme in the absence of any VEGF. This control also gives a basal level of Surface Area. Active 4229 HH+VEGF, corresponds to the co-treatment of cornea with the flt-1 4229 HH ribozyme and VEGF. Inactive 4229 HH+VEGF, corresponds to the co-treatment of cornea with a catalytically inactive version of 4229 HH ribozyme and VEGF.

RIBOZYMES

Ribozymes of this invention block to some extent VEGF-R (specifically flt-1 and flk-1/KDR) production and can be used to treat disease or diagnose such disease. Ribozymes will be delivered to cells in culture, to cells or tissues in animal models of angiogenesis and/or RA and to human cells or tissues ex vivo or in vivo. Ribozyme cleavage of VEGF–R RNAs (specifically RNAs that encode flt-1 and flk-1/KDR) in these systems may alleviate disease symptoms.

Target Sites

Targets for useful ribozymes can be determined as disclosed in Draper et al., International PCT Publication No. WO 95/13380, and hereby incorporated by reference herein in totality. Other examples include the following PCT applications which concern inactivation of expression of disease-related genes: WO 95/23225, WO 95/13380, WO 94/02595, incorporated by reference herein. Rather than repeat the guidance provided in those documents here, below are provided specific examples of such methods, not limiting to those in the art. Ribozymes to such targets are designed as described in those applications and synthesized to be tested in vitro and in vivo, as also described.

The sequence of human and mouse flt-1, KDR and/or flk-1 mRNAs were screened for optimal ribozyme target sites using a computer folding algorithm. Hammerhead or hairpin ribozyme cleavage sites were identified. These sites are shown in Tables II to IX (all sequences are 5' to 3' in the tables; X can be any base-paired sequence, the actual sequence is not relevant here). The nucleotide base position is noted in the Tables as that site to be cleaved by the designated type of ribozyme. While mouse and human sequences can be screened and ribozymes thereafter designed, the human targeted sequences are of most utility. However, as discussed in Stinchcomb et al., "Method and Composition for Treatment of Restenosis and Cancer Using Ribozymes," filed May 18, 1994, U.S. Ser. No. 08/245,466, mouse targeted ribozymes may be useful to test efficacy of action of the ribozyme prior to testing in humans. The nucleotide base position is noted in the Tables as that site to be cleaved by the designated type of ribozyme.

Hammerhead or hairpin ribozymes were designed that could bind and cleave target RNA in a sequence-specific manner. The ribozymes were individually analyzed by computer folding (Jaeger et al., 1989 *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core were eliminated from consideration. Varying binding arm lengths can be chosen to optimize activity.

Referring to FIG. 6, mRNA is screened for accessible cleavage sites by the method described generally in Draper et al., PCT WO93/23569, hereby incorporated by reference herein. Briefly, DNA oligonucleotides complementary to potential hammerhead or hairpin ribozyme cleavage sites were synthesized. A polymerase chain reaction is used to generate substrates for T7 RNA polymerase transcription from human and mouse flt-1, KDR and/or flk-1 cDNA clones. Labeled RNA transcripts are synthesized in vitro from the templates. The oligonucleotides and the labeled transcripts were annealed, RNAseH was added and the mixtures were incubated for the designated times at 37° C. Reactions are stopped and RNA separated on sequencing polyacrylamide gels. The percentage of the substrate cleaved is determined by autoradiographic quantitation using a PhosphorImaging system. From these data, hammerhead or hairpin ribozyme sites are chosen as the most accessible.

Ribozymes of the hammerhead or hairpin motif were designed to anneal to various sites in the mRNA message. The binding arms are complementary to the target site sequences described above. The ribozymes were chemically synthesized. The method of synthesis used follows the procedure for normal RNA synthesis as described in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684 and makes use of common nucleic acid protecting and coupling groups, such as dimethoxytrityl at the 5'-end, and phosphoramidites at the 3'-end. Small scale synthesis were conducted on a 394 Applied Biosystems, Inc. synthesizer using a modified 2.5 μmol scale protocol with a 5 min coupling step for alkylsilyl protected nucleotides and 2.5 min coupling step for 2'-O-methylated nucleotides. Table XI outlines the amounts, and the contact times, of the reagents used in the synthesis cycle. A 6.5-fold excess (163 μL of 0.1 M=16.3 μmol) of phosphoramidite and a 24-fold excess of S-ethyl tetrazole (238 μL of 0.25 M=59.5 μmol) relative to polymer-bound 5'-hydroxyl was used in each coupling cycle. Average coupling yields on the 394 Applied Biosystems, Inc. synthesizer, determined by colorimetric quantitation of the trityl fractions, were 97.5–99%. Other oligonucleotide synthesis reagents for the 394 Applied Biosystems, Inc. synthesizer : detritylation solution was 2% TCA in methylene chloride (ABI); capping was performed with 16% N-methyl imidazole in THF (ABI) and 10% acetic anhydride/10% 2,6-lutidine in THF (ABI); oxidation solution was 16.9 mM $I_2$, 49 mM pyridine, 9% water in THF (Millipore). B & J Synthesis Grade acetonitrile was used directly from the reagent bottle. S-Ethyl tetrazole solution (0.25 M in acetonitrile) was made up from the solid obtained from American International Chemical, Inc.

Deprotection of the RNA was performed as follows. The polymer-bound oligoribonucleotide, trityl-off, was transferred from the synthesis column to a 4 mL glass screw top vial and suspended in a solution of methylamine (MA) at 65° C. for 10 min. After cooling to −20° C., the supernatant was removed from the polymer support. The support was washed three times with 1.0 mL of $EtOH:MeCN:H_2O/3:1:1$, vortexed and the supernatant was then added to the first supernatant. The combined supernatants, containing the oligoribonucleotide, were dried to a white powder.

The base-deprotected oligoribonucleotide was resuspended in anhydrous TEA.HF/NMP solution (250 μL of a solution of 1.5 mL N-methyl-pyrrolidinone, 750 μL TEA and 1.0 mL TEA3.HF to provide a 1.4M HF concentration) and heated to 65° C. for 1.5 h. The resulting, fully deprotected, oligomer was quenched with 50 mM TEAB (9 mL) prior to anion exchange desalting.

For anion exchange desalting of the deprotected oligomer, the TEAB solution was loaded onto a Qiagen 500® anion exchange cartridge (Qiagen Inc.) that was prewashed with 50 mM TEAB (10 mL). After washing the loaded cartridge with 50 mM TEAB (10 mL), the RNA was eluted with 2 M TEAB (10 mL) and dried down to a white powder.

Inactive hammerhead ribozymes were synthesized by substituting a U for G5 and a U for A14 (numbering from Hertel, K. J., et al., 1992, Nucleic Acids Res., 20, 3252). The average stepwise coupling yields were >98% (Wincott et al., 1995 Nucleic Acids Res. 23, 2677–2684).

Hairpin ribozymes are synthesized in two parts and annealed to reconstruct the active ribozyme (Chowrira and Burke, 1992 *Nucleic Acids Res.*, 20, 2835–2840). Ribozymes are also synthesized from DNA templates using bacteriophage T7 RNA polymerase (Milligan and Uhlenbeck, 1989, *Methods Enzymol.* 180, 51).

All ribozymes are modified extensively to enhance stability by modification with nuclease resistant groups, for example, 2'-amino, 2'-C-allyl, 2'-flouro, 2'-O-methyl, 2'-H (for a review see Usman and Cedergren, 1992 TIBS 17, 34; Usman et al., 1994 Nucleic Acids Symp. Ser. 31, 163). Ribozymes are purified by gel electrophoresis using general methods or are purified by high pressure liquid chromatography (HPLC; See Usman et al., Synthesis, deprotection, analysis and purification of RNA and ribozymes, filed May, 18, 1994, U.S. Ser. No. 08/245,736 Wincott et al., Supra, the totality of which is hereby incorporated herein by reference) and are resuspended in water.

The sequences of the ribozymes that are chemically synthesized, useful in this study, are shown in Tables II to IX. Those in the art will recognize that these sequences are representative only of many more such sequences where the enzymatic portion of the ribozyme (all but the binding arms) is altered to affect activity. Stem-loop IV sequence of hairpin ribozymes listed in for example Table III (5'-CACGUUGUG-3') can be altered (substitution, deletion, and/or insertion) to contain any sequence, provided a minimum of two base-paired stem structure can form. The sequences listed in Tables II to IX may be formed of ribonucleotides or other nucleotides or non-nucleotides. Such ribozymes are equivalent to the ribozymes described specifically in the Tables.

Optimizing Ribozyme Activity

Ribozyme activity can be optimized as described by Stinchcomb et al., supra. The details will not be repeated here, but include altering the length of the ribozyme binding arms (stems I and III, see FIG. 2c), or chemically synthesizing ribozymes with modifications that prevent their degradation by serum ribonucleases (see e.g., Eckstein et al., International Publication No.

WO 92/07065; Perrault et al., 1990 Nature 344, 565; Pieken et al., 1991 Science 253, 314; Usman and Cedergren, 1992 Trends in Biochem. Sci. 17, 334; Usman et al., International Publication No. WO 93/15187; Rossi et al., International Publication No. WO 91/03162; Beigelman et al., 1995 J. Biol Chem. in press; as well as Sproat, U.S. Pat. No. 5,334,711 which describe various chemical modifications that can be made to the sugar moieties of enzymatic RNA molecules). Modifications which enhance their efficacy in cells, and removal of stem II bases to shorten RNA synthesis times and reduce chemical requirements are desired. (All these publications are hereby incorporated by reference herein).

Sullivan, et al., supra, describes the general methods for delivery of enzymatic RNA molecules. Ribozymes may be administered to cells by a variety of methods known to those familiar to the art, including, but not restricted to, encapsulation in liposomes. by iontophoresis, or by incorporation into other vehicles. such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Sullivan et aL, supra and Draper et al., supra which have been incorporated by reference herein.

Another means of accumulating high concentrations of a ribozyme(s) within cells is to incorporate the ribozyme-encoding sequences into a DNA or RNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990 Proc. Natl. Acad. Sci. U S A, 87, 6743–7; Gao and Huang 1993 Nucleic Acids Res., 21, 2867–72; Lieber et al., 1993 Methods Enzymol., 217, 47–66; Zhou et al., 1990 Mol. Cell. Biol., 10, 4529–37; Thompson et al., 1995 supra). Several investigators have demonstrated that ribozymes expressed from such promoters can function in mammalian cells (e.g. Kashani-Sabet et al., 1992 Antisense Res. Dev., 2, 3–15; Ojwang et al., 1992 Proc. Natl. Acad. Sci. U S A, 89,10802–6; Chen et al., 1992 Nucleic Acids Res., 20, 4581–9; Yu et al., 1993 Proc. Natl. Acad. Sci. U S A, 90, 6340–4; L'Huillier et al., 1992 EMBO J. 11, 4411–8; Lisziewicz et al., 1993 Proc. Natl. Acad. Sci. U. S. A., 90, 8000–4; Thompson et al., 1995 Nucleic Acids Res. 23, 2259). The above ribozyme transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors).

In a preferred embodiment of the invention, a transcription unit expressing a ribozyme that cleaves RNAs that encode flt-1, KDR and/or flk-1 are inserted into a plasmid DNA vector or an adenovirus or adeno-associated virus DNA viral vector or a retroviral RNA vector. Viral vectors have been used to transfer genes and lead to either transient or long term gene expression (Zabner et aL, 1993 Cell 75, 207; Carter, 1992 Curr. Opi. Biotech. 3, 533). The adenovirus, AAV or retroviral vector is delivered as recombinant viral particles. The DNA may be delivered alone or complexed with vehicles (as described for RNA above). The recombinant adenovirus or AAV or retroviral particles are locally administered to.,the site of, treatment, e.g., through incubation or inhalation in vivo or by direct application to cells or tissues ex vivo. Retroviral vectors have also been used to express ribozymes in mammalian cells (Ojwang et al., 1992 supra; Thompson et al., 1995 supra).

flt-1, KDR and/or flk-1 are attractive nucleic acid-based therapeutic targets by several criteria. The interaction between VEGF and VEGF-R is well-established. Efficacy can be tested in well-defined and predictive animal models. Finally, the disease conditions are serious and current therapies are inadequate. Whereas protein-based therapies would inhibit VEGF activity nucleic acid-based therapy provides a direct and elegant approach to directly modulate flt-1, KDR and/or flk-1 expression.

Because flt-1 and KDR mRNAs are highly homologous in certain regions, some ribozyme target sites are also homologous (see Table X). In this case, a single ribozyme will target both flt-1 and KDR mRNAs. At partially homologous sites, a single ribozyme can sometimes be designed to accomodate a site on both mRNAs by including G/U basepairing. For example, if there is a G present in a ribozyme target site in KDR mRNA at the same position there is an A in the flt-1 ribozyme target site, the ribozyme can be synthesized with a U at the complementary position and it will bind both to sites. The advantage of one ribozyme that targets both VEGF-R mRNAs is clear, especially in cases where both VEGF receptors may contribute to the progression of angiogenesis in the disease state.

"Angiogenesis" refers to formation of new blood vessels which is an essential process in reproduction, development and wound repair. "Tumor angiogenesis" refers to the induction of the growth of blood vessels from surrounding tissue into a solid tumor. Tumor growth and tumor metastasis are dependent on angiogenesis (for a review see Folkman, 1985 supra; Folkman 1990 J. Natl. Cancer Inst., 82, 4; Folkman and Shing, 1992 J. Biol. Chem. 267, 10931).

Angiogenesis plays an important role in other diseases such as arthritis wherein new blood vessels have been shown to invade the joints and degrade cartilage (Folkman and Shing, supra).

"Retinopathy" refers,to inflammation of the retina and/or degenerative condition of the retina which may lead to occlusion of the retina and eventual blindness. In "diabetic retinopathy" angiogenesis causes the capillaries in the retina to invade the vitreous resulting in bleeding and blindness which is also seen in neonatal retinopathy (for a review see Folkman, 1985 supra; Folkman 1990 supra; Folkman and Shing, 1992 supra).

EXAMPLE 1 flt-1, KDR and/or flk-1 Ribozymes

By engineering ribozyme motifs applicant has designed several ribozymes directed against flt-1, KDR and/or flk-1 encoded mRNA sequences. These ribozymes were synthesized with modifications that improve their nuclease resistance (Beigelman et al., 1995 *J Biol. Chem.* 270, 25702) and enhance their activity in cells. The ability of ribozymes to cleave target sequences in vitro was evaluated essentially as described in Thompson et al., PCT Publication No. WO 93/23057; Draper et al., PCT Publication No. WO 95/04818.

EXAMPLE 2

Effect of Ribozymes on the Binding of VEGF to flt-1, KDR and/or flk-1 Receptors Several common human cell lines are available that express endogenous flt-1, KDR and/or flk-1, flt-1, KDR and/or flk-1 can be detected easily with monoclonal antibodies. Use of appropriate fluorescent reagents and fluorescence-activated cell-sorting (FACS) will permit direct quantitation of surface flt-1, KDR and/or flk-1 on a cell-by-cell basis. Active ribozymes are expected to directly educe flt-1, KDR and/or flk-1 expression and thereby reduce VEGF binding to the cells. In this example, human umbelical cord microvascular endothelial cells were used.

Cell Preparation

Plates are coated with 1.5% gelatin and allowed to stand for one hour. Cells (e.g., microvascular endothelial cells derived from human umbilical cord vein) are plated at 20,000 cells/well (24 well plate) in 200 µl growth media and incubated overnight (~1 doubling) to yield ~40,000 cells (75–80% confluent).

Ribozyme Treatment

Media is removed from cells and the cells are washed two times with 300 µl 1×PBS: $Ca^{2+}$: $Mg^{2+}$ mixture. A complex of 200–500 nM ribozyme and LipofectAMINE® (3:1 lipid:phosphate ratio) in 200 µl OptiMEM® (5% FBS) was added to the cells. The cells are incubated for 6 hr (equivalent to 2–3 VEGF–R turnovers).

$^{125}I$ VEGF Binding Assay

The assay is carried out on ice to inhibit internalization of VEGF during the experiment. The media containing the ribozyme is removed from the cells and the cells are washed twice with with 300 µl 1×PBS: $Ca^{2+}$: $Mg^{2+}$ mixture containing 1% BSA. Appropriate $^{125}I$ VEGF solution (100,000 cpm/well, +/−10 × cold 1×PBS, 1% BSA) was applied to the cells. The cells are incubated on ice for 1 h. $^{125}I$ VEGF-containing solution is removed and the cells are washed three times with with 300 µl 1×PBS: $Ca^{2+}$: $Mg^{2+}$ mixture containing 1% BSA. To each well 300 µl of 100 mM Tris-HCl, pH 8.0, 0.5% Triton X-100 was added and the the mixture was incubated for 2 min. The $^{125}I$ VEGF-binding was quantitated using standard scintillation counting techniques. Percent inhibition was calculated as follows:

$$Percent\ Inhibition = \frac{cpm^{125}|VEGF\ bound\ by\ the\ ribozyme\text{-}treated\ samples}{cpm^{125}|VEGF\ bound\ by\ the\ Control\ sample} \times 100$$

EXAMPLE 3

Effect of Hammerhead Ribozymes Targeted Against flt-1 Receptor on the Binding of VEGF Hammerhead ribozymes targeted to twenty sites within flt-1 RNA were synthesized as described above. Sequence of the ribozymes used are shown in Table II; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, 3' end of the ribozyme contains a 3'-3' linked inverted abasic ribose.

Referring to FIG. 7, the effect of hammerhead ribozymes targeted against flt-1 receptor on the binding of VEGF to flt-1 on the surface of human microvascular endothelial cells is shown. The majority of the ribozymes tested were able to inhibit the expression of flt-1 and thereby were able to inhibit the binding of VEGF.

In order to determine the specificity of ribozymes targeted against flt-1 RNA, the effect of five anti-flt-1 ribozymes on the binding of VEGF, UPA (urokinase plasminogen activator) and FGF (fibroblast growth factor) to their corresponding receptors were assayed. As shown in FIG. 9, there was significant inhibition of VEGF binding to its receptors on cells treated with anti-flt-1 ribozymes. There was no specific inhibition of the binding of UPA and FGF to their corresponding receptors. These data strongly suggest that anti-flt-1 ribozymes specifically cleave flt-1 RNA and not RNAs encoding the receptors for UPA and FGF, resulting in the inhibition of flt-1 receptor expression on the surface of the cells. Thus the ribozymes are responsible for the inhibition of VEGF binding but not the binding of UPA and FGF.

EXAMPLE 4

Effect of Hammerhead Ribozymes Targeted Against KDR Receptor on the Binding of VEGF Hammerhead ribozymes targeted to twenty one sites within KDR RNA were synthesized as described above. Sequence of the ribozymes used are shown in Table IV; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose.

Referring to FIG. 8, the effect of hammerhead ribozymes targeted against KDR receptor on the binding of VEGF to KDR on the surface of human microvascular endothelial cells is shown. A majority of the ribozymes tested were able to inhibit the expression of KDR and thereby were able to inhibit the binding of VEGF. As a control, the cells were treated with a ribozyme that is not targeted towards KDR RNA (irrel. RZ); there was no specific inhibition of VEGF binding. The results from this control experiment strongly suggest that the inhibition of VEGF binding observed with anti-KDR ribozymes is a ribozyme-mediated inhibition.

EXAMPLE 5

Effect of Ribozymes Targeted Against VEGF Receptors on Cell Proliferation

Cell Preparation 24-well plates are coated with 1.5% gelatin (porcine skin 300 bloom). After 1 hr, excess gelatin is washed off of the plate. Microvascular endothelial cells are plated at 5,000 cells/well (24 well plate) in 200 µl growth media. The cells are allowed to grow for ~18 hr (~1 doubling) to yield ~10,000 cells (25–30% confluent).

Ribozyme Treatment

Media is removed from the cells, and the cells are washed two times with 300 µl 1×PBS: $Ca^{2+}$: $Mg^{2+}$ mixture.

For anti-flt-1 HH ribozyme experiment (FIG. 12) a complex of 500 nM ribozyme; 15 µM LFA (3:1 lipid:phosphate ratio) in 200 µl OptiMEM (5% FCS) media was added to the cells. Incubation of cells is carried out for 6 hr (equivalent to 2–3 VEGF receptor turnovers).

For anti-KDR HH ribozyme experiment (FIG. 13) a complex of 200 nM ribozyme; 5.25 µM LFA (3:1 lipid:phosphate ratio) in 200 µl OptiMEM (5% FCS) media was added to the cells. Incubation of cells is carried out for 3 hr.

Proliferation

After three or six hours, the media is removed from the cells and the cells are washed with 300 µl 1×PBS: $Ca^{2+}$: $Mg^{2+}$ mixture. Maintenance media (contains dialyzed 10% FBS) +/−VEGF or basic FGF at 10 ng/ml is added to the cells. The cells are incubated for 48 or 72 h. The cells are trypsinized and counted (Coulter counter). Trypan blue is added on one well of each treatment as control.

Figure 12B:
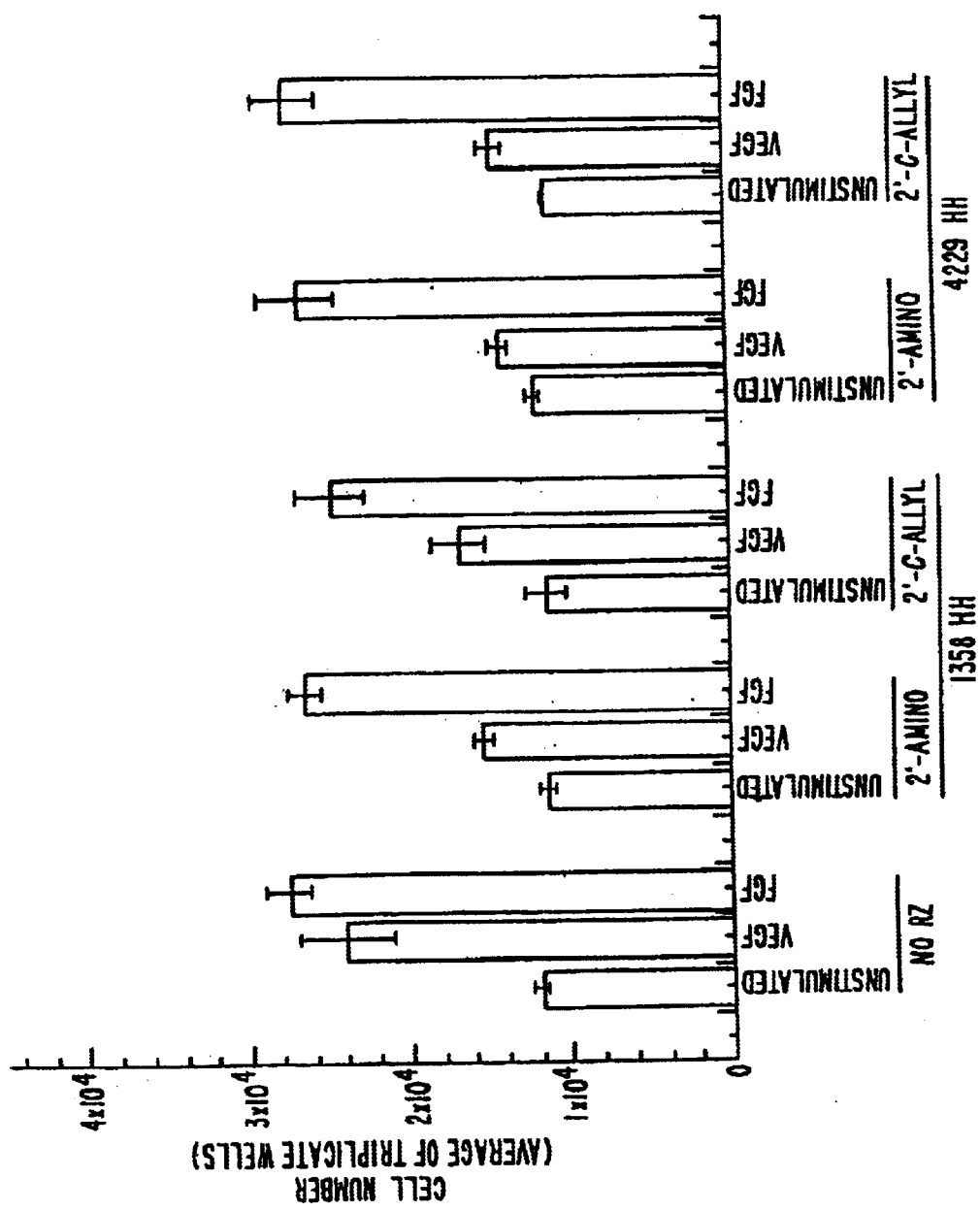

As shown in FIG. 12B, VEGF and basic FGF can stimulate human microvascular endothelial cell proliferation. However, treatment of cells with 1358 HH or 4229 HH ribozymes, targeted against flt-1 mRNA, results in a significant decrease in the ability of VEGF to stimulate endothelial cell proliferation. These ribozymes do not inhibit the FGF-mediated stimulation of endothelial cell proliferation.

Human microvascular endothalial cells were also treated with hammerhead ribozymes targeted against sites 527, 730, 3702 or 3950 within the KDR mRNA. As shown in FIG. 13, all four ribozymes caused significant inhibition of VEGF-mediated induction of cell proliferation. No significant inhibition of cell proliferation was observed when the cells were treated with a hammerhead ribozyme targeted to an irrelevant RNA. Additionally, none of the ribozymes inhibited FGF-mediated stimulation of cell proliferation.

These results strongly suggest that hammerhead ribozymes targeted against either flt-1 or KDR mRNA can specifically inhibit VEGF-mediated induction of endothelial cell proliferation.

EXAMPLE 6

Effect of Antisense Oligonucleotides Targeted Against VEGF Receptors on Cell Proliferation (Calorimetric Assay)

Following are some of the reagents used in the proliferation assay:

Cells

Human aortic endothelial cells (HAEC) from Clonetics®. Cells at early passage are preferably used.

Uptake Medium

EBM (from Clonetics®);1% L-Glutamine;20 mM Hepes;No serum;No antibiotics.

Growth Medium

EGM (from Clonetics®);FBS to 20%;1% L-Glutamine; 20 mM Hepes.

Cell Plating 96-well tissue culture plates are coated with 0.2% gelatin (50 µl/well). The gelatin is incubated in the wells at room temperature for 15–30 minutes. The gelatin is removed by aspiration and the wells are washed with PBS:$Ca^{2+}$: $Mg^{2+}$ mixture. PBS mixture is left in the wells until cells are ready to be added. HAEC cells were detached by trypsin treatment and resuspended at $1.25 \times 10^4$/ml in growth medium. PBS is removed from plates and 200 µl of cells (i.e. $2.5 \times 10^3$ cells/well) are added to each well. The cells are allowed to grow for 48 hours before the proliferation assay.

Assay

Growth medium is removed from the wells. The cells are washed twice with PBS:$Ca^{2+}$: $Mg^{2+}$ mixture without antibiotics. A formulation of lipid/antisense oligonucleotide (antisense oligonucleotide is used here as a non-limiting example) complex is added to each well (100 µl/well) in uptake medium. The cells are incubated for 2–3 hours at 37° C. in $CO_2$ incubator. After uptake, 100 µl/well of growth medium is added (gives final FBS concentration of 10%). After approximately 72 hours, 40 µl MTS® stock solution (made as described by manufacturer) was added to each well and incubated at 37° C. for 1–3 hours, depending on the color development. (For this assay, 2 hours was sufficient). The intensity of color formation was determined on a plate reader at 490 nM.

Phosphorothioate-substituted antisense oligodeoxynucleotides were custom synthesized by The Midland Certified Reagent Company®, Midland, Tex. Following non-limiting antisense oligodeoxynucleotides targeted against KDR RNA were used in the proliferation assay:

KDR 21 AS: 5'-GCA GCA CCT TGC TCT
    CCA TCC-3'     (SEQ ID NO. 8230)

SCRAMBLED CONTROL: 5'-CTG CCA ACT TCC CAT GCC
    TGC-3'     (SEQ ID NO. 8231)

As shown in FIG. 10, proliferation of HAEC cells are specifically inhibited by increasing concentrations of the phosphorothioate anti-KDR-antisense oligodeoxynucleotide. The scrambled antisense oligonucleotide is not expected to bind the KDR RNA and therefore is not expected to inhibit KDR expression. As expected, there is no detectable inhibition of proliferation of HAEC cells treated with a phosphorothioate antisense oligonucleotide with scrambled sequence.

EXAMPLE 7

In vitro Cleavage of flt-1 RNA by Hammerhead Ribozymes

Referring to FIG. 11A, hammerhead ribozymes (HH) targeted against sites 1358 and 4229 within the flt-1 RNA were synthesized as described above.

RNA Cleavage Assay In vitro

Substrate RNA was 5' end-labeled using [$\gamma$-$^{32}$P] ATP and T4 polynucleotide kinase (US Biochemicals). Cleavage reactions were carried out under ribozyme "excess" conditions. Trace amount (≦1 nM) of 5' end-labled substrate and 40 nM unlabeled ribozyme were denatured and renatured separately by heating to 90° C. for 2 min and snap-cooling on ice for 10–15 min. The ribozyme and substrate were incubated, separately, at 37° C. for 10 min in a buffer containing 50 mM Tris-HCl and 10 mM MgCl$_2$. The reaction was initiated by mixing the ribozyme and substrate solutions and incubating at 37° C. Aliquots of 5 µl are taken at regular intervals of time and the reaction is quenched by mixing with equal volume of 2×formamide stop mix. The samples are resolved on 20% denaturing polyacrylamide gels. The results were quantified and percentage of target RNA, cleaved is plotted as a function of time.

Figure 11B:
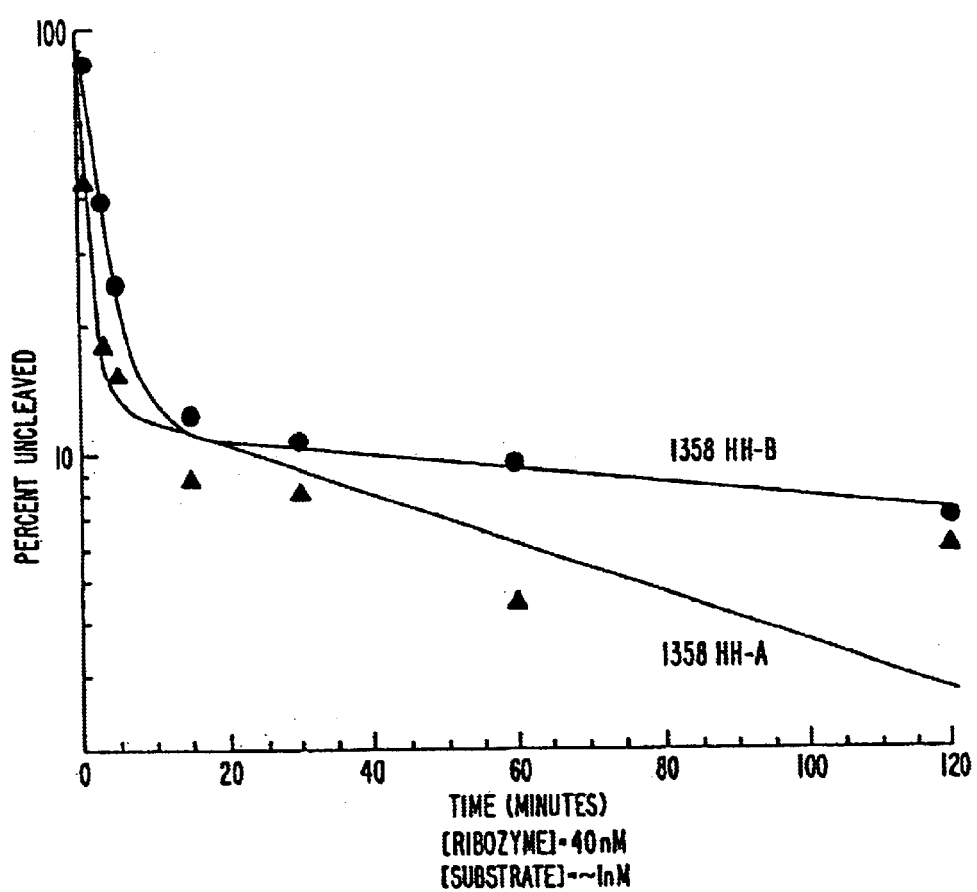
Figure 11C:
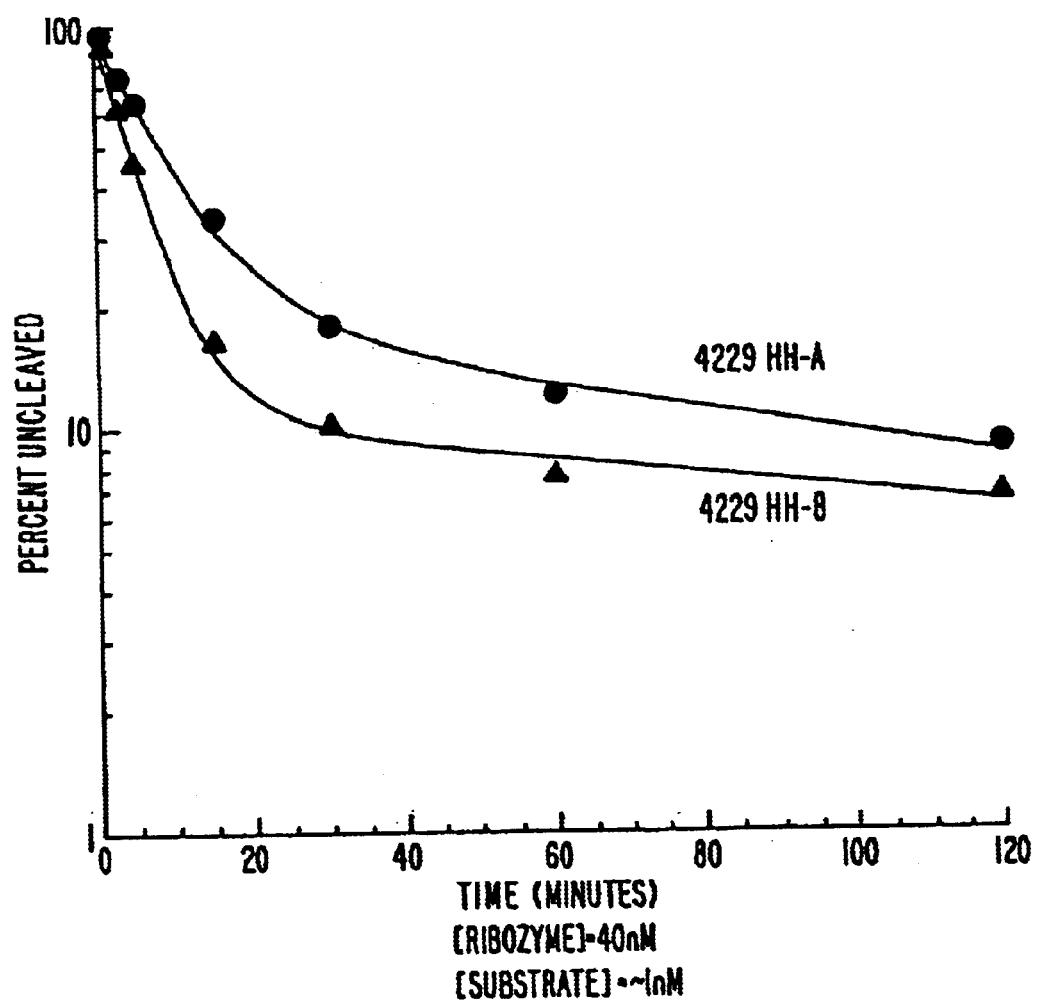

Referring to FIGS. 11B and 11C, hammerhead ribozymes targeted against sites 1358 and 4229 within the flt-1 RNA are capable of cleaving target RNA efficiently in vitro.

EXAMPLE 8

In vitro Cleavage of KDR RNA by Hammerhead Ribozymes

In this non-limiting example, hammerhead ribozymes targeted against sites 726, 527, 3702 and 3950 within KDR RNA were synthesized as described above. RNA cleavage reactions were carried out in vitro essentially as described under Example 7.

Referring to FIGS. 14 and 15, all four ribozymes were able to cleave their cognate target RNA efficiently in a sequence-specific manner.

EXAMPLE 9

In vitro Cleavage of RNA by Hammerhead Ribozymes Targeted Against Cleavage Sites that Are Homologous Between KDR and flt-1 mRNA Because flt-1 and KDR mRNAs are highly homologous in certain regions, some ribozyme target sites are also homologous (see Table X). In this case, a single ribozyme will target both flt-1 and KDR mRNAs. Hammerhead ribozyme (FLT/KDR-1) targeted against one of the homologous sites between flt-1 and KDR (flt-1 site 3388 and KDR site 3151) was synthesized as described above. Ribozymes with either a 3 bp stem II or a 4 bp stem II were synthesized. RNA cleavage reactions were carried out in vitro essentially as described under Example 7.

Referring to FIG. 16, FLT/KDR-I ribozyme with either a 3 or a 4 bp stem II was able to cleave its target RNA efficiently in vitro.

EXAMPLE 10

Effect of Multiple Ribozymes Targeted Against Both flt-1 and KDR RNA on Cell Proliferation Since both flt-1 and KDR receptors of VEGF are involved in angiogenesis, the inhibition of the expression of both of these genes may be an effective approach to inhibit angiogenesis.

Human microvascular endothalial cells were treated with hammerhead ribozymes targeted against sites flt-1 4229 alone, KDR 527 alone, KDR 726 alone, KDR 3950 alone. flt-1 4229+KDR 527, flt-1 4229+KDR 726 or flt-1 4229+KDR 3950. As shown in FIG. 17, all the combinations of active ribozymes (A) caused significant inhibition of VEGF-mediated induction of cell proliferation. No significant inhibition of cell proliferation was observed when the cells were treated with a catalytically inactive (I) hammerhead ribozymes. Additionally, cells treated with ribozymes targeted against both flt-1 and KDR RNAs—flt-1 4229+KDR 527; flt-1 4229+KDR 726; flt-1 4229+KDR 3950, were able to cause a greater inhibition of VEGF-mediated induction of cell proliferation when compared with individual ribozymes targeted against either flt-1 or KDR RNA (see flt-1 4229 alone; KDR 527 alone; KDR 726 alone; KDR 3950 alone). This strongly suggests that treatment of cells with multiple ribozymes may be a more effective means of inhibition of gene expression.

Animal Models

There are several animal models in which the anti-angiogenesis effect of nucleic acids of the present invention, such as ribozymes, directed against VEGF-R mRNAs can be tested. Typically a corneal model has been used to study angiogenesis in rat and rabbit since recruitment of vessels can easily be followed in this normally avascular tissue (Pandey et al., 1995 *Science* 268: 567–569). In these models, a small Teflon or Hydron disk pretreated with an angiogenesis factor (e.g. bFGF or VEGF) is inserted into a pocket surgically created in the cornea. Angiogenesis is monitored 3 to 5 days later. Ribozymes directed against VEGF-R mRNAs would be delivered in the disk as well, or dropwise to the eye over the time course of the experiment. In another eye model, hypoxia has been shown to cause both increased expression of VEGF and neovascularization in the retina (Pierce et al., 1995 *Proc. Natl. Acad. Sci.* USA. 92: 905–909; Shweiki et aL, 1992 *J. Clin. Invest.* 91: 2235–2243).

In human glioblastomas, it has been shown that VEGF is at least partially responsible for tumor angiogenesis (Plate et al., 1992 *Nature* 359, 845). Animal models have been developed in which glioblastoma cells are implanted subcutaneously into nude mice and the progress of tumor growth and angiogenesism is studied (Kim et al., 1993 supra; Millauer et al., 1994 supra).

Another animal model that addresses neovascularization involves Matrigel, an extract of basement membrane that becomes a solid gel when injected subcutaneously (Passaniti et al., 1992 *Lab. Invest.* 67: 519–528). When the Matrigel is supplemented with angiogenesis factors such as VEGF, vessels grow into the Matrigel over a period of 3 to 5 days and angiogenesis can be assessed. Again, ribozymes directed against VEGF-R mRNAs would be delivered in the Matrigel.

Several animal models exist for screening of anti-angiogenic agents. These include corneal vessel formation following corneal injury (Burger et al., 1985 *Cornea* 4: 35–41; Lepri, et al., 1994 *J. Ocular Pharmacol.* 10: 273–280; Ormerod et al., 1990 *Am. J. Pathol.* 137: 1243–1252) or intracorneal growth factor implant (Grant et al., 1993 *Diabetologia* 36: 282–291; Pandey et al. 1995 supra; Zieche et al., 1992 *Lab. Invest.* 67: 711–715), vessel growth into Matrigel matrix containing growth factors (Passaniti et al., 1992 supra), female reproductive organ neovascularization following hormonal manipulation (Shweiki et al., 1993 *Clin. Invest.* 91: 2235–2243), several models involving inhibition of tumor growth in highly vascularized solid tumors (O'Reilly et aL, 1994 *Cell* 79: 315–328; Senger et al., 1993 *Cancer and Metas. Rev.* 12: 303–324; Takahasi et al., 1994 *Cancer Res.* 54: 4233–4237; Kim et al., 1993 supra), and transient hypoxia-induced neovascularization in the mouse retina (Pierce et al., 1995 *Proc. Natl. Acad. Sci.* USA. 92: 905–909).

The cornea model, described in Pandey et al. supra, is the most common and well characterized anti-angiogenic agent efficacy screening model. This model involves an avascular tissue into which vessels are recruited by a stimulating agent (growth factor, thermal or alkalai burn, endotoxin). The corneal model would utilize the intrastromal corneal implantation of a Teflon pellet soaked in a VEGF-Hydron solution to recruit blood vessels toward the pellet which can be quantitated using standard microscopic and image analysis techniques. To evaluate their anti-angiogenic efficacy, ribozymes are applied topically to the eye or bound within Hydron on the Teflon pellet itself. This avascular cornea as well as the Matrigel (see below) provide for low background assays. While the corneal model has been performed extensively in the rabbit, studies in the rat have also been conducted.

The mouse model (Passaniti et al. supra) is a non-tissue model which utilizes Matrigel, an extract of basement membrane (Kleinman et al., 1986) or Millipore® filter disk, which can be impregnated wvith growth factors and anti-angiogenic agents in a liquid form prior to injection. Upon subcutaneous administration at body temperature, the Matrigel or Millipore® filter disk forms a solid implant. VEGF embedded in the Matrigel or Millipore® filter disk would be used to recruit vessels within the matrix of the Matrigel or Millipore® filter disk which can be processed histologically for endothelial cell specific vWF (factor VIII antigen) immunohistochemistry, Trichrome-Masson stain, or hemoglobin content. Like the cornea, the Matrigel or Millipore® filter disk are avascular; however, it is not tissue. In the Matrigel or Millipore® filter disk model, ribozymes are administered within the matrix of the Matrigel or Millipore® filter disk to test their anti-angiogenic efficacy. Thus, delivery issues in this model, as with delivery of ribozymes by Hydron-coated Teflon pellets in the rat cornea model, may be less problematic due to the homogeneous presence of the ribozyme within the respective matrix.

These models offer a distinct advantage over several other angiogenic models listed previously. The ability to use VEGF as a pro-angiogenic stimulus in both models is highly desirable since ribozymes will target only VEGFr mRNA. In other words, the involvement of other non-specific types of stimuli in the cornea and Matrigel models is not advantageous from the standpoint of understanding the pharmacologic mechanism by which the anti-VEGFr mRNA ribozymes produce their effects. In addition, the models will allow for testing the specificity of the anti-VEGFr mRNA ribozymes by using either a- or bFGF as a pro-angiogenic factor. Vessel recruitment using FGF should not be affected in either model by anti-VEGFr mRNA ribozymes. Other models of angiogenesis including vessel formation in the female reproductive system using hormonal manipulation (Shweiki et al., 1993 supra); a variety of vascular solid tumor models which involve indirect correltations with angiogenesis (O'Reilly et al., 1994 supra; Senger et al., 1993 supra; Takahasi et al., 1994 supra; Kim et al., 1993 supra); and retinal neovascularization following transient hypoxia (Pierce et al., 1995 supra) were not selected for efficacy screening due to their non-specific nature, although there is a correlation between VEGF and angiogenesis in these models.

Other model systems to study tumor angiogenesis is reviewed by Folkman, 1985 Adv. Cancer. Res., 43, 175.

flt-1, KDR and/or flk-1 protein levels can be measured clinically or experimentally by FACS analysis. flt-1, KDR and/or flk-1 encoded mRNA levels will be assessed by Northern analysis, RNase-protection, primer extension analysis and/or quantitative RT-PCR. Ribozymes that block flt-1, KDR and/or flk-1 protein encoding mRNAs and therefore result in decreased levels of flt-1, KDR and/or flk-1 activity by more than 20% in vitro will be identified.

Ribozymes and/or genes encoding them are delivered by either free delivery, liposome delivery, cationic lipid delivery, adeno-associated virus vector delivery, adenovirus vector delivery, retrovirus vector delivery or plasmid vector delivery in these animal model experiments (see above).

Patients can be treated by locally administering nucleic acids targeted against VEGF–R by direct injection. Routes of administration may include, but are not limited to, intravascular, intramuscular, subcutaneous, intraarticular, aerosol inhalation, oral (tablet, capsule or pill form), topical, systemic, ocular, intraperitoneal and/or intrathecal delivery.

EXAMPLE 11

Ribozyme-mediated Inhibition of Angiogenesis In vivo

The purpose of this study was to assess the anti-angiogenic activity of hammerhead ribozymes targeted against flt-1 4229 site in the rat cornea model of VEGF induced angiogenesis (see above). These ribozymes have either active or inactive catalytic core and either bind and cleave or just bind to VEGF–R mRNA of the flt-1 subtype. The active ribozymes, that are able to bind and cleave the target RNA, have been shown to inhibit ($^{125}$I-labeled) VEGF binding in cultured endothelial cells and produce a dose-dependent decrease in VEGF induced endothelial cell proliferation in these cells (see Examples 3–5 above). The catalytically inactive forms of these ribozymes, wherein the ribozymes can only bind to the RNA but cannot catalyze RNA cleavage, fail to show these characteristics. The ribozymes and VEGF were co-delivered using the filter disk method: Nitrocellulose filter disks (Millipore®) of 0.057 diameter were immersed in appropriate solutions and were surgically implanted in rat cornea as described by Pandey et al., supra. This delivery method has been shown to deliver rhodamine-labeled free ribozyme to scleral cells and, in all likelihood cells of the pericorneal vascular plexus. Since the active ribozymes show cell culture efficacy and can be delivered to the target site using the disk method, it is essential that these ribozymes be assessed for in vivo anti-angiogenic activity.

The stimulus for angiogenesis in this study was the treatment of the filter disk with 30 μM VEGF which is implanted within the cornea's stroma. This dose yields reproducible neovascularization stemming from the pericorneal vascular plexus growing toward the disk in a dose-response study 5 days following implant. Filter disks treated only with the vehicle for VEGF show no angiogenic response. The ribozymes was co-adminstered with VEGF on a disk in two different ribozyme concentrations. One concern with the simultaneous administration is that the ribozymes will not be able to inhibit angiogenesis since VEGF receptors can be stimulated. However, we have observed that in low VEGF doses, the neovascular response reverts to normal suggesting that the VEGF stimulus is essential for maintaining the angiogenic response. Blocking the production of VEGF receptors using simultaneous administration of anti-VEGF–R mRNA ribozymes could attenuate the normal neovascularization induced by the filter disk treated with VEGF.

MATERIALS AND METHODS
1. Stock Hammerhead Ribozyme Solutions
   a. flt-1 4229 (786 µM)—Active
   b. flt-1 4229 (736 µM)—Inactive
2. Experimantal Solutions/groups

| Group 1 | Solution 1 | Control VEGF solution: 30 µM in 82 mM Tris base |
| Group 2 | Solution 2 | flt-1 4229 (1 µg/µL) in 30 µM VEGF/82 mM Tris base |
| Group 3 | Solution 3 | flt-1 4229 (10 µg/µL) in 30 µM VEGF/82 mM Tris base |
| Group 4 | Solution 4 | No VEGF, flt-1 4229 (10 µg/µL) in 82 mM Tris base |
| Group 5 | Solution 5 | No VEGF, No ribozyme in 82 mM Tris base |

10 eyes per group, 5 animals (Since they have similar molecular weights, the molar concentrations should be essentially similar).

Each solution (VEGF and RIBOZYMES) were prepared as a 2× solution for 1:1 mixing for final concentrations above, with the exception of solution 1 in which VEGF was 2× and diluted with ribozyme diluent (sterile water).

3. VEGF Solutions

The 2×VEGF solution (60 µM) was prepared from a stock of 0.82 µg/µL in 50 mM Tris base. 200 µL of VEGF stock was concentrated by speed vac to a final volume of 60.8 µL, for a final concentration of 2.7 µg/µL or 60 µM. Six 10 µL aliquots was prepared for daily mixing. 2× solutions for VEGF and Ribozyme was stored at 4° C. until the day of the surgery. Solutions were mixed for each day of surgery. Original 2× solutions was prepared on the day before the first day of the surgery.

4. Surgical Solutions

Anesthesia
   stock ketamine hydrochloride 100 mg/mL
   stock xylazine hydrochloride 20 mg/mL
   stock acepromazine 10 mg/mL Final Anesthesia Solution
   50 mg/mL ketamine, 10 mg/mL xylazine, and 0.5 mg/mL acepromazine 5% povidone iodine for opthalmic surgical wash
   2% lidocaine (sterile) for opthalmic administration (2 drops per eye)
   sterile 0.9% NaCl for opthalmic irrigation 5. Surgical Methods Standard surgical procedure as described in Pandey et al, supra. Filter disks were incubated in 1 µL of each solution for approximately 30 minutes prior to implantation.

5. Experimental Protocol

The animal cornea were treated with the treatment groups as described above. Animals were allowed to recover for 5 days after treatment with daily observation (scoring 0–3). On the fifth day animals were euthanized and digital images of each eye was obtained for quantitaion using Image Pro Plus. Quantitated neovascular surface area were analyzed by ANOVA followed by two post-hoc tests including Dunnets and Tukey-Kramer tests for significance at the 95% confidence level. Dunnets provide information on the significance between the differences within the means of treatments vs. controls while Tukey-Kramer provide information on the significance of differences within the means of each group.

Results are graphically represented in FIG. 18. As shown in the figure, flt-1 4229 active hammerhead ribozyme at both concentrations was effective at inhibiting angiogenesis while the inactive ribozyme did not show any significant reduction in angiogenesis. A statistically signifiant reduction in neovascular surface area was observed only with active ribozymes. This result clearly shows that the ribozymes are capable of significantly inhibiting angiogenesis in vivo. Specifically, the mechanism of inhibition appears to be by the binding and cleavage of target RNA by ribozymes.

Diagnostic Uses

Ribozymes of this invention may be used as diagnostic tools to examine genetic drift and mutations within diseased cells or to detect the presence of flt-1, KDR and/or flk-1 RNA in a cell. The close relationship between ribozyme activity and the structure of the target RNA allows the detection of mutations in any region of the molecule which alters the base-pairing and three-dimensional structure of the target RNA. By using multiple ribozymes described in this invention, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These experiments will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes of this invention are well known in the art, and include detection of the presence of mRNAs associated with flt-1, KDR and/or flk-1 related condition. Such RNA is detected by determining the presence of a cleavage product after treatment with a ribozyme using standard methodology.

In a specific example, ribozymes which can cleave only wild-type or mutant forms of the target RNA are used for the assay. The first ribozyme is used to identify wild-type RNA present in the sample and the second ribozyme will be used to identify mutant RNA in the sample. As reaction controls, synthetic substrates of both wild-type and mutant RNA will be cleaved by both ribozymes to demonstrate the relative ribozyme efficiencies in the reactions and the absence of cleavage of the "non-targeted" RNA species. The cleavage products from the synthetic substrates will also serve to generate size markers for the analysis of wild-type and mutant RNAs in the sample population. Thus each analysis will require two ribozymes, two substrates and one unknown sample which will be combined into six reactions. The presence of cleavage products will be determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., flt-1, KDR and/or flk-1) is adequate to establish risk. If probes of comparable specific activity are used for both transcripts, then a qualitative comparison of RNA levels will be adequate and will decrease the cost of the initial diagnosis. Higher mutant form to wild-type ratios will be correlated with higher risk whether RNA levels are compared qualitatively or quantitatively.

TABLE II

Human flt1 VEGF Receptor-Hammerhead Ribozyme and Substrate Sequence

| Pos | Substrate | Seq ID No | HH Ribozyme | Seq ID No |
|---|---|---|---|---|
| 10 | CGGACACUC CUCUCGGC | 1 | GCCGAGAG CUGAUGAGGNNNNNNNNCCGAA AGUGUCCG | 4157 |
| 13 | ACACUCCUC UCGGCUCC | 2 | GGAGCCGA CUGAUGAGGNNNNNNNNCCGAA AGGAGUGU | 4158 |
| 15 | ACUCCUCUC GGCUCCUC | 3 | GAGGAGCC CUGAUGAGGNNNNNNNNCCGAA AGAGGAGU | 4159 |
| 20 | UCUCGGCUC CUCCCCGG | 4 | CCGGGGAG CUGAUGAGGNNNNNNNNCCGAA AGCCGAGA | 4160 |
| 23 | CGGCUCCUC CCCGGCAG | 5 | CUGCCGGG CUGAUGAGGNNNNNNNNCCGAA AGGAGCCG | 4161 |
| 43 | CGGCGGCUC GGAGCGGG | 6 | CCCGCUCC CUGAUGAGGNNNNNNNNCCGAA AGCCGCCG | 4162 |
| 54 | AGCGGGCUC CGGGGCUC | 7 | GAGCCCCG CUGAUGAGGNNNNNNNNCCGAA AGCCCGCU | 4163 |
| 62 | CCGGGGCUC GGGUGCAG | 8 | CUGCACCC CUGAUGAGGNNNNNNNNCCGAA AGCCCCGG | 4164 |
| 97 | GCGAGGAUU ACCCGGGG | 9 | CCCCGGGU CUGAUGAGGNNNNNNNNCCGAA AUCCUCGC | 4165 |
| 98 | CGAGGAUUA CCCGGGGA | 10 | UCCCCGGG CUGAUGAGGNNNNNNNNCCGAA AAUCCUCG | 4166 |
| 113 | GAAGUGGUU GUCUCCUG | 11 | CAGGAGAC CUGAUGAGGNNNNNNNNCCGAA ACCACUUC | 4167 |
| 116 | GUGGUUGUC UCCUGGCU | 12 | AGCCAGGA CUGAUGAGGNNNNNNNNCCGAA ACAACCAC | 4168 |
| 118 | GGUUGUCUC CUGGCUGG | 13 | CCAGCCAG CUGAUGAGGNNNNNNNNCCGAA AGACAACC | 4169 |
| 145 | CGGGCGCUC AGGGCGCG | 14 | CGCGCCCU CUGAUGAGGNNNNNNNNCCGAA AGCGCCCG | 4170 |
| 185 | GACGGACUC UGGCGGCC | 15 | GGCCGCCA CUGAUGAGGNNNNNNNNCCGAA AGUCCGUC | 4171 |
| 198 | GGCCGGGUC GUUGGCCG | 16 | CGGCCAAC CUGAUGAGGNNNNNNNNCCGAA ACCCGGCC | 4172 |
| 201 | CGGGUCGUU GGCCGGGG | 17 | CCCCGGCC CUGAUGAGGNNNNNNNNCCGAA ACGACCCG | 4173 |
| 240 | GGCCGCGUC GCGCUCAC | 18 | GUGAGCGC CUGAUGAGGNNNNNNNNCCGAA ACGCGGCC | 4174 |
| 246 | GUCGCGCUC ACCAUGGU | 19 | ACCAUGGU CUGAUGAGGNNNNNNNNCCGAA AGCGCGAC | 4175 |
| 255 | ACCAUGGUC AGCUACUG | 20 | CAGUAGCU CUGAUGAGGNNNNNNNNCCGAA ACCAUGGU | 4176 |
| 260 | GGUCAGCUA CUGGGACA | 21 | UGUCCCAG CUGAUGAGGNNNNNNNNCCGAA AGCUGACC | 4177 |
| 276 | ACCGGGGUC CUGGCGUG | 22 | CACACGCC CUGAUGAGGNNNNNNNNCCGAA ACCCCGGU | 4178 |
| 294 | GCGCUGCUC AGCUGUCU | 23 | AGACAGCU CUGAUGAGGNNNNNNNNCCGAA AGCAGCGC | 4179 |
| 301 | UCAGCUGUC UGCUUCUC | 24 | GAGAAGCA CUGAUGAGGNNNNNNNNCCGAA ACAGCUGA | 4180 |
| 306 | UGUCGCUU CUCACAGG | 25 | CCUGUGAG CUGAUGAGGNNNNNNNNCCGAA AGCAGACA | 4181 |
| 307 | GUCUGCUUC UCACAGGA | 26 | UCCUGUGA CUGAUGAGGNNNNNNNNCCGAA AAGCAGAC | 4182 |
| 309 | CUGCUUCUC ACAGGAUC | 27 | GAUCCUGU CUGAUGAGGNNNNNNNNCCGAA AGAAGCAG | 4183 |
| 317 | CACAGGAUC UAGUUCAG | 28 | CUGAACUA CUGAUGAGGNNNNNNNNCCGAA AUCCUGUG | 4184 |
| 319 | CAGGAUCUA GUUCAGGU | 29 | ACCUGAAC CUGAUGAGGNNNNNNNNCCGAA AGAUCCUG | 4185 |
| 322 | GAUCUAGUU CAGGUUCA | 30 | UGAACCUG CUGAUGAGGNNNNNNNNCCGAA ACUAGAUC | 4186 |
| 323 | AUCUAGUUC AGGUUCAA | 31 | UUGAACCU CUGAUGAGGNNNNNNNNCCGAA AACUAGAU | 4187 |
| 328 | GUUCAGGUU CAAAAUUA | 32 | UAAUUUUG CUGAUGAGGNNNNNNNNCCGAA ACCUGAAC | 4188 |
| 329 | UUCAGGUUC AAAAUUAA | 33 | UUAAUUUU CUGAUGAGGNNNNNNNNCCGAA AACCUGAA | 4189 |
| 335 | UUCAAAAUU AAAAGAUC | 34 | GAUCUUUU CUGAUGAGGNNNNNNNNCCGAA AUUUUGAA | 4190 |
| 336 | UCAAAAUUA AAAGAUCC | 35 | GGAUCUUU CUGAUGAGGNNNNNNNNCCGAA AAUUUUGA | 4191 |
| 343 | UAAAAGAUC CUGAACUG | 36 | CAGUUCAG CUGAUGAGGNNNNNNNNCCGAA AUCUUUUA | 4192 |
| 355 | AACUGAGUU AAAAGGC | 37 | GCCUUUUA CUGAUGAGGNNNNNNNNCCGAA ACUCAGUU | 4193 |
| 356 | ACUGAGUUU AAAAGGCA | 38 | UGCCUUUU CUGAUGAGGNNNNNNNNCCGAA AACUCAGU | 4194 |
| 357 | CUGAGUUUA AAAGGCAG | 39 | GUGCCUUU CUGAUGAGGNNNNNNNNCCGAA AAACUCAG | 4195 |
| 375 | CAGCACAUC AUGCAAGC | 40 | GCUUGCAU CUGAUGAGGNNNNNNNNCCGAA AUGUGCUG | 4196 |
| 400 | CACUGCAUC UCCAAUGC | 41 | GCAUUGGA CUGAUGAGGNNNNNNNNCCGAA AUGCAGUG | 4197 |
| 402 | CUGCAUCUC CAAUGCAG | 42 | CUGCAUUG CUGAUGAGGNNNNNNNNCCGAA AGAUGCAG | 4198 |
| 427 | CAGCCCAUA AAUGGUCU | 43 | AGACCAUU CUGAUGAGGNNNNNNNNCCGAA AUGGGCUG | 4199 |
| 434 | UAAAUGGUC UUUGCCUG | 44 | CAGGCAAA CUGAUGAGGNNNNNNNNCCGAA ACCAUUUA | 4200 |
| 436 | AAUGGUCUU UGCCUGAA | 45 | UUCAGGCA CUGAUGAGGNNNNNNNNCCGAA AGACCAUU | 4201 |
| 437 | AUGGUCUUU GCCUGAAA | 46 | UUUCAGGC CUGAUGAGGNNNNNNNNCCGAA AAGACCAU | 4202 |
| 454 | UGGGAGUA ACUAAAUC | 47 | GCUUUCCU CUGAUGAGGNNNNNNNNCCGAA ACUCACCA | 4203 |
| 477 | CUGAGCAUA ACUAAAUC | 48 | GAUUUAGU CUGAUGAGGNNNNNNNNCCGAA AUGCUCAG | 4204 |
| 481 | GCAUAACUA AAUCUGCC | 49 | GGCAGAUU CUGAUGAGGNNNNNNNNCCGAA AGUUAUGC | 4205 |
| 485 | AACUAAAUC UGCCUGUG | 50 | CACAGGCA CUGAUGAGGNNNNNNNNCCGAA AUUUAGUU | 4206 |
| 512 | CAAACAAUU CUGCAGUA | 51 | UACUGCAG CUGAUGAGGNNNNNNNNCCGAA AUUGUUUG | 4207 |
| 513 | AAACAAUUC UGCAGUAC | 52 | GUACUGCA CUGAUGAGGNNNNNNNNCCGAA AAUUGUUU | 4208 |
| 520 | UCUGCAGUA CUUUAACC | 53 | GGUUAAAG CUGAUGAGGNNNNNNNNCCGAA ACUGCAGA | 4209 |
| 523 | GCAGUACUU UAACCUUG | 54 | CAAGGUUA CUGAUGAGGNNNNNNNNCCGAA AGUACUGC | 4210 |
| 524 | CAGUACUUU AACCUUGA | 55 | UCAAGGUU CUGAUGAGGNNNNNNNNCCGAA AAGUACUG | 4211 |
| 525 | AGUACUUUA ACCUUGAA | 56 | UUCAAGGU CUGAUGAGGNNNNNNNNCCGAA AAAGUACU | 4212 |
| 530 | UUUAACCUU GAACACAG | 57 | CUGUGUUC CUGAUGAGGNNNNNNNNCCGAA AGGUUAAA | 4213 |
| 541 | ACACAGCUC AAGCAAAC | 58 | GUUUGCUU CUGAUGAGGNNNNNNNNCCGAA AGCUGUGU | 4214 |
| 560 | CACUGGCUU CUACAGCU | 59 | AGCUGUAG CUGAUGAGGNNNNNNNNCCGAA AGCCAGUG | 4215 |
| 561 | ACUGGCUUC UACAGCUG | 60 | CAGCUGUA CUGAUGAGGNNNNNNNNCCGAA AAGCCAGU | 4216 |
| 563 | UGGCUUCUA CAGCUGCA | 61 | UGCAGCUG CUGAUGAGGNNNNNNNNCCGAA AGAAGCCA | 4217 |
| 575 | CUGCAAAUA UCUAGCUG | 62 | CAGCUAGA CUGAUGAGGNNNNNNNNCCGAA AUUUGCAG | 4218 |
| 577 | GCAAAUAUC UAGCUGUA | 63 | UACAGCUA CUGAUGAGGNNNNNNNNCCGAA AUAUUUGC | 4219 |
| 579 | AAAUAUCUA GCUGUACC | 64 | GGUACAGC CUGAUGAGGNNNNNNNNCCGAA AGAUAUUU | 4220 |
| 585 | CUAGCUGUA CCUACUUC | 65 | GAAGUAGG CUGAUGAGGNNNNNNNNCCGAA ACAGCUAG | 4221 |
| 589 | CUGUACCUA CUUCAAAG | 66 | CUUUGAAG CUGAUGAGGNNNNNNNNCCGAA AGGUACAG | 4222 |
| 592 | UACCUACUU CAAAGAAG | 67 | CUUCUUUG CUGAUGAGGNNNNNNNNCCGAA AGUAGGUA | 4223 |
| 593 | ACCUACUUC AAAGAAGU | 68 | UCUUCUUU CUGAUGAGGNNNNNNNNCCGAA AAGUAGGU | 4224 |
| 614 | AACAGAAUC UGCAAUCU | 69 | AGAUUGCA CUGAUGAGGNNNNNNNNCCGAA AUUCUGUU | 4225 |
| 621 | UCUGCAAUC UAUAUAUU | 70 | AAUAUAUA CUGAUGAGGNNNNNNNNCCGAA AUUGCAGA | 4226 |
| 623 | UGCAAUCUA UAUAUUUA | 71 | UAAAUAUA CUGAUGAGGNNNNNNNNCCGAA AGAUUGCA | 4227 |
| 625 | CAAUCUAUA UAUUUAUU | 72 | AAUAAAUA CUGAUGAGGNNNNNNNNCCGAA AUAGAUUG | 4228 |
| 627 | AUCUAUAUA UUUAUUAG | 73 | CUAAUAAA CUGAUGAGGNNNNNNNNCCGAA AUAUAGAU | 4229 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 629 | CUAUAUAUU UAUUAGUG | 74 | CACUAAUA CUGAUGAGGNNNNNNNNCCGAA AUAUAUAG | 4230 |
| 630 | UAUAUAUUU AUUAGUGA | 75 | UCACUAAU CUGAUGAGGNNNNNNNNCCGAA AAUAUAUA | 4231 |
| 631 | AUAUAUUUA UUAGUGAU | 76 | AUCACUAA CUGAUGAGGNNNNNNNNCCGAA AAAUAUAU | 4232 |
| 633 | AUAUUUAUU AGUGAUAC | 77 | GUAUCACU CUGAUGAGGNNNNNNNNCCGAA AUAAAUAU | 4233 |
| 634 | UAUUUAUUA GUGAUACA | 78 | UGUAUCAC CUGAUGAGGNNNNNNNNCCGAA AAUAAAUA | 4234 |
| 640 | UUAGUGAUA CAGGUAGA | 79 | UCUACCUG CUGAUGAGGNNNNNNNNCCGAA AUCACUAA | 4235 |
| 646 | AUACAGGUA GACCUUUC | 80 | GAAAGGUC CUGAUGAGGNNNNNNNNCCGAA ACCUGUAU | 4236 |
| 652 | GUAGACCUU UCGUAGAG | 81 | CUCUACGA CUGAUGAGGNNNNNNNNCCGAA AGGUCUAC | 4237 |
| 653 | UAGACCUUU CGUAGAGA | 82 | UCUCUACG CUGAUGAGGNNNNNNNNCCGAA AAGGUCUA | 4238 |
| 654 | AGACCUUUC GUAGAGAU | 83 | AUCUCUAC CUGAUGAGGNNNNNNNNCCGAA AAAGGUCU | 4239 |
| 657 | CCUUUCGUA GAGAUGUA | 84 | UACAUCUC CUGAUGAGGNNNNNNNNCCGAA ACGAAAGG | 4240 |
| 665 | AGAGAUGUA CAGUGAAA | 85 | UUUCACUG CUGAUGAGGNNNNNNNNCCGAA ACAUCUCU | 4241 |
| 675 | AGUGAAAUC CCCGAAAU | 86 | AUUUCGGG CUGAUGAGGNNNNNNNNCCGAA AUUUCACU | 4242 |
| 684 | CCCGAAAUU AUACACAU | 87 | AUGUGUAU CUGAUGAGGNNNNNNNNCCGAA AUUUCGGG | 4243 |
| 685 | CCGAAAUUA UACACAUG | 88 | CAUGUGUA CUGAUGAGGNNNNNNNNCCGAA AAUUUCGG | 4244 |
| 687 | GAAAUUAUA CACAUGAC | 89 | GUCAUGUG CUGAUGAGGNNNNNNNNCCGAA AUAAUUUC | 4245 |
| 711 | AGGGAGCUC GUCAUUCC | 90 | GGAAUGAC CUGAUGAGGNNNNNNNNCCGAA AGCUCCCU | 4246 |
| 714 | GAGCUCGUC AUUCCCUG | 91 | CAGGGAAU CUGAUGAGGNNNNNNNNCCGAA ACGAGCUC | 4247 |
| 717 | CUCGUCAUU CCCUGCCG | 92 | CGGCAGGG CUGAUGAGGNNNNNNNNCCGAA AUGACGAG | 4248 |
| 718 | UCGUCAUUC CCUGCCGG | 93 | CCGGCAGG CUGAUGAGGNNNNNNNNCCGAA AAUGACGA | 4249 |
| 729 | UGCCGGGUU ACGUCACC | 94 | GGUGACGU CUGAUGAGGNNNNNNNNCCGAA ACCCGGCA | 4250 |
| 730 | GCCGGGUUA CGUCACCU | 95 | AGGUGACG CUGAUGAGGNNNNNNNNCCGAA AACCCGGC | 4251 |
| 734 | GGUUACGUC ACCUAACA | 96 | UGUUAGGU CUGAUGAGGNNNNNNNNCCGAA ACGUAACC | 4252 |
| 739 | CGUCACCUA ACAUCACU | 97 | AGUGAUGU CUGAUGAGGNNNNNNNNCCGAA AGGUGACG | 4253 |
| 744 | CCUAACAUC ACUGUUAC | 98 | GUAACAGU CUGAUGAGGNNNNNNNNCCGAA AUGUUAGG | 4254 |
| 750 | AUCACUGUU ACUUUAAA | 99 | UUUAAAGU CUGAUGAGGNNNNNNNNCCGAA ACAGUGAU | 4255 |
| 751 | UCACUGUUA CUUUAAAA | 100 | UUUUAAAG CUGAUGAGGNNNNNNNNCCGAA AACAGUGA | 4256 |
| 754 | CUGUUACUU UAAAAAAG | 101 | CUUUUUUA CUGAUGAGGNNNNNNNNCCGAA AGUAACAG | 4257 |
| 755 | UGUUACUUU AAAAAGU | 102 | ACUUUUUU CUGAUGAGGNNNNNNNNCCGAA AAGUAACA | 4258 |
| 756 | GUUACUUUA AAAAGUU | 103 | AACUUUUU CUGAUGAGGNNNNNNNNCCGAA AAAGUAAC | 4259 |
| 764 | AAAAAGUU UCCACUUG | 104 | CAAGUGGA CUGAUGAGGNNNNNNNNCCGAA ACUUUUUU | 4260 |
| 765 | AAAAGUUU CCACUUGA | 105 | UCAAGUGG CUGAUGAGGNNNNNNNNCCGAA AACUUUUU | 4261 |
| 766 | AAAGUUUC CACUUGAC | 106 | GUCAAGUG CUGAUGAGGNNNNNNNNCCGAA AAACUUUU | 4262 |
| 771 | UUUCCACUU GACACUUU | 107 | AAAGUGUC CUGAUGAGGNNNNNNNNCCGAA AGUGGAAA | 4263 |
| 778 | UUGACACU UGAUCCCU | 108 | AGGGAUCA CUGAUGAGGNNNNNNNNCCGAA ACGUGUCAA | 4264 |
| 779 | UGACACUUU GAUCCCUG | 109 | CAGGGAUC CUGAUGAGGNNNNNNNNCCGAA AAGUGUCA | 4265 |
| 783 | ACUUUGAUC CCUGAUGG | 110 | CCAUCAGG CUGAUGAGGNNNNNNNNCCGAA AUCAAAGU | 4266 |
| 801 | AAACGCAUA AUCUGGGA | 111 | UCCCAGAU CUGAUGAGGNNNNNNNNCCGAA AUGCGUUU | 4267 |
| 804 | CGCAUAAUC UGGGACAG | 112 | CUGUCCCA CUGAUGAGGNNNNNNNNCCGAA AUUAUGCG | 4268 |
| 814 | GGGACAGUA GAAAGGGC | 113 | GCCCUUUC CUGAUGAGGNNNNNNNNCCGAA ACUGUCCC | 4269 |
| 824 | AAAGGGCUU CAUCAUAU | 114 | AUAUGAUG CUGAUGAGGNNNNNNNNCCGAA AGCCCUUU | 4270 |
| 825 | AAGGGCUUC AUCAUAUC | 115 | GAUAUGAU CUGAUGAGGNNNNNNNNCCGAA AAGCCCUU | 4271 |
| 828 | GGCUUCAUC AUAUCAAA | 116 | UUUGAUAU CUGAUGAGGNNNNNNNNCCGAA AUGAAGCC | 4272 |
| 831 | UUCAUCAUA UCAAAUGC | 117 | GCAUUUGA CUGAUGAGGNNNNNNNNCCGAA AUGAUGAA | 4273 |
| 833 | CAUCAUAUC AAAUGCAA | 118 | UUGCAUUU CUGAUGAGGNNNNNNNNCCGAA AUAUGAUG | 4274 |
| 845 | UGCAACGUA CAAAGAAA | 119 | UUUCUUUG CUGAUGAGGNNNNNNNNCCGAA ACGUUGCA | 4275 |
| 855 | AAAGAAAUA GGGCUCU | 120 | AGAAGCCC CUGAUGAGGNNNNNNNNCCGAA AUUUCUUU | 4276 |
| 861 | AUAGGGCUU CUGACCUG | 121 | CAGGUCAG CUGAUGAGGNNNNNNNNCCGAA AGCCCUAU | 4277 |
| 862 | UAGGGCUUC UGACCUGU | 122 | ACAGGUCA CUGAUGAGGNNNNNNNNCCGAA AAGCCCUA | 4278 |
| 882 | GCAACAGUC AAUGGGCA | 123 | UGCCCAUU CUGAUGAGGNNNNNNNNCCGAA ACUGUUGC | 4279 |
| 892 | AUGGGCAUU UGUAUAAG | 124 | CUUAUACA CUGAUGAGGNNNNNNNNCCGAA AUGCCCAU | 4280 |
| 893 | UGGGCAUUU GUAUAAGA | 125 | UCUUAUAC CUGAUGAGGNNNNNNNNCCGAA AAUGCCCA | 4281 |
| 896 | GCAUUUGUA UAAGACAA | 126 | UUGUCUUA CUGAUGAGGNNNNNNNNCCGAA ACAAAUGC | 4282 |
| 898 | AUUUGUAUA AGACAAAC | 127 | GUUUGUCU CUGAUGAGGNNNNNNNNCCGAA AUACAAAU | 4283 |
| 908 | GACAAACUA UCUCACAC | 128 | GUGUGAGA CUGAUGAGGNNNNNNNNCCGAA AGUUUGUC | 4284 |
| 910 | CAAACUAUC UCACACAU | 129 | AUGUGUGA CUGAUGAGGNNNNNNNNCCGAA AUAGUUUG | 4285 |
| 912 | AACUAUCUC ACACAUCG | 130 | CGAUGUGU CUGAUGAGGNNNNNNNNCCGAA AGAUAGUU | 4286 |
| 919 | UCACACAUC GACAAACC | 131 | GGUUUGUC CUGAUGAGGNNNNNNNNCCGAA AUGUGUGA | 4287 |
| 931 | AAACCAAUA CAAUCAUA | 132 | UAUGAUUG CUGAUGAGGNNNNNNNNCCGAA AUUGGUUU | 4288 |
| 936 | AAUACAAUC AUAGUCCA | 133 | ACAUCUAC CUGAUGAGGNNNNNNNNCCGAA AUUGUAUU | 4289 |
| 939 | ACAAUCAUA GUGUCCA | 134 | UGGACAUC CUGAUGAGGNNNNNNNNCCGAA AUGAUUGU | 4290 |
| 945 | AUAGUGUC CAAAUAAG | 135 | CUUAUUUG CUGAUGAGGNNNNNNNNCCGAA ACAUCUAU | 4291 |
| 951 | GUCCAAAUA AGCACACC | 136 | GGUGUGCU CUGAUGAGGNNNNNNNNCCGAA AUUUGGAC | 4292 |
| 969 | CGCCCAGUC AAAUUACU | 137 | AGUAAUUU CUGAUGAGGNNNNNNNNCCGAA ACUGGGCG | 4293 |
| 974 | AGUCAAAUU ACUUAGAG | 138 | CUCUAAGU CUGAUGAGGNNNNNNNNCCGAA AUUUGACU | 4294 |
| 975 | GUCAAAUUA CUUAGAGG | 139 | CCUCUAAG CUGAUGAGGNNNNNNNNCCGAA AAUUUGAC | 4295 |
| 978 | AAAUUACUU AGAGGCCA | 140 | UGGCCUCU CUGAUGAGGNNNNNNNNCCGAA AGUAAUUU | 4296 |
| 979 | AAUUACUUA GAGGCCAU | 141 | AUGGCCUC CUGAUGAGGNNNNNNNNCCGAA AAGUAAUU | 4297 |
| 988 | GAGGCCAUA CUCUUGUC | 142 | GACAAGAG CUGAUGAGGNNNNNNNNCCGAA AUGGCCUC | 4298 |
| 991 | GCCAUACUC UUGUCCUC | 143 | GAGGACAA CUGAUGAGGNNNNNNNNCCGAA AGUAUGGC | 4299 |
| 993 | CAUACUCUU GUCCUCAA | 144 | UUGAGGAC CUGAUGAGGNNNNNNNNCCGAA AGAGUAUG | 4300 |
| 996 | ACUCUUGUC CUCAAUUG | 145 | CAAUUGAG CUGAUGAGGNNNNNNNNCCGAA ACAAGAGU | 4301 |
| 999 | CUUGUCCUC AAUUGUAC | 146 | GUACAAUU CUGAUGAGGNNNNNNNNCCGAA AGGACAAG | 4302 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1003 | UCCUCAAUU GUACUGCU | 147 | AGCAGUAC CUGAUGAGGNNNNNNNNCCGAA AUUGAGGA | 4303 |
| 1006 | UCAAUUGUA CUGCUACC | 148 | GGUAGCAG CUGAUGAGGNNNNNNNNCCGAA ACAAUUGA | 4304 |
| 1012 | GUACUGCUA CCACUCCC | 149 | GGGAGUGG CUGAUGAGGNNNNNNNNCCGAA AGCAGUAC | 4305 |
| 1018 | CUACCACUC CCUUGAAC | 150 | GUUCAAGG CUGAUGAGGNNNNNNNNCCGAA AGUGGUAG | 4306 |
| 1022 | CACUCCCUU GAACACGA | 151 | UCGUGUUC CUGAUGAGGNNNNNNNNCCGAA AGGGAGUG | 4307 |
| 1035 | ACGAGAGUU CAAAUGAC | 152 | GUCAUUUG CUGAUGAGGNNNNNNNNCCGAA ACUCUCGU | 4308 |
| 1036 | CGAGAGUUC AAAUGACC | 153 | GGUCAUUU CUGAUGAGGNNNNNNNNCCGAA AACUCUCG | 4309 |
| 1051 | CCUGGAGUU ACCCUGAU | 154 | AUCAGGGU CUGAUGAGGNNNNNNNNCCGAA ACUCCAGG | 4310 |
| 1052 | CUGGAGUUA CCCUGAUG | 155 | CAUCAGGG CUGAUGAGGNNNNNNNNCCGAA AACUCCAG | 4311 |
| 1069 | AAAAAAAUA AGAGAGCU | 156 | AGCUCUCU CUGAUGAGGNNNNNNNNCCGAA AUUUUUUU | 4312 |
| 1078 | AGAGAGCUU CCGUAAGG | 157 | CCUUACGG CUGAUGAGGNNNNNNNNCCGAA AGCUCUCU | 4313 |
| 1079 | GAGAGCUUC CGUAAGGC | 158 | GCCUUACG CUGAUGAGGNNNNNNNNCCGAA AAGCUCUC | 4314 |
| 1083 | GCUUCCGUA AGGCGACG | 159 | CGUCGCCU CUGAUGAGGNNNNNNNNCCGAA ACGGAAGC | 4315 |
| 1095 | CGACGAAUU GACCAAAG | 160 | CUUUGGUC CUGAUGAGGNNNNNNNNCCGAA AUUCGUCG | 4316 |
| 1108 | AAAGCAAUU CCCAUGCC | 161 | GGCAUGGG CUGAUGAGGNNNNNNNNCCGAA AUUGCUUU | 4317 |
| 1109 | AAGCAAUUC CCAUGCCA | 162 | UGGCAUGG CUGAUGAGGNNNNNNNNCCGAA AAUUGCUU | 4318 |
| 1122 | GCCAACAUA UUCUACAG | 163 | CUGUAGAA CUGAUGAGGNNNNNNNNCCGAA AUGUUGGC | 4319 |
| 1124 | CAACAUAUU CUACAGUG | 164 | CACUGUAG CUGAUGAGGNNNNNNNNCCGAA AUAUGUUG | 4320 |
| 1125 | AACAUAUUC UACAGUGU | 165 | ACACUGUA CUGAUGAGGNNNNNNNNCCGAA AAUAUGUU | 4321 |
| 1127 | CAUAUUCUA CAGUGUUC | 166 | GAACACUG CUGAUGAGGNNNNNNNNCCGAA AGAAUAUG | 4322 |
| 1134 | UACAGUGUU CUUACUAU | 167 | AUAGUAAG CUGAUGAGGNNNNNNNNCCGAA ACACUGUA | 4323 |
| 1135 | ACAGUGUUC UUACUAUU | 168 | AAUAGUAA CUGAUGAGGNNNNNNNNCCGAA AACACUGU | 4324 |
| 1137 | AGUGUUCUU ACUAUUGA | 169 | UCAAUAGU CUGAUGAGGNNNNNNNNCCGAA AGAACACU | 4325 |
| 1138 | GUGUUCUUA CUAUUGAC | 170 | GUCAAUAG CUGAUGAGGNNNNNNNNCCGAA AAGAACAC | 4326 |
| 1141 | UUCUUACUA UUGACAAA | 171 | UUUGUCAA CUGAUGAGGNNNNNNNNCCGAA AGUAAGAA | 4327 |
| 1143 | CUUACUAUU GACAAAAU | 172 | AUUUUGUC CUGAUGAGGNNNNNNNNCCGAA AUAGUAAG | 4328 |
| 1173 | AAAGGACUU AUACUUUG | 173 | CAAAGUAU CUGAUGAGGNNNNNNNNCCGAA AGUCCUUU | 4329 |
| 1174 | AAGGACUUU AUACUUGU | 174 | ACAAGUAU CUGAUGAGGNNNNNNNNCCGAA AAGUCCUU | 4330 |
| 1175 | AGGACUUUA UACUUGUC | 175 | GACAAGUA CUGAUGAGGNNNNNNNNCCGAA AAAGUCCU | 4331 |
| 1177 | GACUUUAUA CUUGUCGU | 176 | ACGACAAG CUGAUGAGGNNNNNNNNCCGAA AUAAAGUC | 4332 |
| 1180 | UUUAUACUU GUCGUGUA | 177 | UACACGAC CUGAUGAGGNNNNNNNNCCGAA AGUAUAAA | 4333 |
| 1183 | AUACUUGUC GUGUAAGG | 178 | CCUUACAC CUGAUGAGGNNNNNNNNCCGAA ACAAGUAU | 4334 |
| 1188 | UGUCGUGUA AGGAGUGG | 179 | CCACUCCU CUGAUGAGGNNNNNNNNCCGAA ACACGACA | 4335 |
| 1202 | UGGACCAUC AUUCAAAU | 180 | AUUUGAAU CUGAUGAGGNNNNNNNNCCGAA AUGGUCCA | 4336 |
| 1205 | ACCAUCAUU CAAAUCUG | 181 | CAGAUUUG CUGAUGAGGNNNNNNNNCCGAA AAUGAUGGU | 4337 |
| 1206 | CCAUCAUUC AAAUCUGU | 182 | ACAGAUUU CUGAUGAGGNNNNNNNNCCGAA AAUGAUGG | 4338 |
| 1211 | AUUCAAAUC UGUUAACA | 183 | UGUUAACA CUGAUGAGGNNNNNNNNCCGAA AUUUGAAU | 4339 |
| 1215 | AAAUCUGUU AACACCUC | 184 | GAGGUGUU CUGAUGAGGNNNNNNNNCCGAA ACAGAUUU | 4340 |
| 1216 | AAUCUGUUA ACACCUCA | 185 | UGAGGUGU CUGAUGAGGNNNNNNNNCCGAA AACAGAUU | 4341 |
| 1223 | UAACCCUC AGUGCAUA | 186 | UAUGCACU CUGAUGAGGNNNNNNNNCCGAA AGGUGUUA | 4342 |
| 1231 | CAGUGCAUA UAUAUGAU | 187 | AUCAUAUA CUGAUGAGGNNNNNNNNCCGAA AUGCACUG | 4343 |
| 1233 | GUGCAUAUA UAUGAUAA | 188 | UUAUCAUA CUGAUGAGGNNNNNNNNCCGAA AUAUGCAC | 4344 |
| 1235 | GCAUAUAUA UGAUAAGG | 189 | CUUUAUCA CUGAUGAGGNNNNNNNNCCGAA AUAUAUGC | 4345 |
| 1240 | UAUAUGAUA AGCAUUC | 190 | GAAUGCUU CUGAUGAGGNNNNNNNNCCGAA AUCAUAUA | 4346 |
| 1247 | UAAAGCAUU CAUCACUG | 191 | CAGUGAUG CUGAUGAGGNNNNNNNNCCGAA AUGCUUUA | 4347 |
| 1248 | AAAGCAUUC AUCACUGU | 192 | ACAGUGAU CUGAUGAGGNNNNNNNNCCGAA AAUGCUUU | 4348 |
| 1251 | GCAUUCAUC ACUGUGAA | 193 | UUCACAGU CUGAUGAGGNNNNNNNNCCGAA AUGAAUGC | 4349 |
| 1264 | UGAAACAUC GAAAACAG | 194 | CUGUUUUC CUGAUGAGGNNNNNNNNCCGAA AUGUUUCA | 4350 |
| 1281 | CAGGUGCUU GAAACCGU | 195 | ACGGUUUC CUGAUGAGGNNNNNNNNCCGAA AGCACCUG | 4351 |
| 1290 | GAAACCGUA GCUGGCAA | 196 | UUGCCAGC CUGAUGAGGNNNNNNNNCCGAA ACGGUUUC | 4352 |
| 1304 | CAAGCGGUC UUACCGGC | 197 | GCCGGUAA CUGAUGAGGNNNNNNNNCCGAA ACCGCUUG | 4353 |
| 1306 | AGCGGUCUU ACCGGCUC | 198 | GAGCCGGU CUGAUGAGGNNNNNNNNCCGAA AGACCGCU | 4354 |
| 1307 | GCGGUCUUA CCGGCUCU | 199 | AGAGCCGG CUGAUGAGGNNNNNNNNCCGAA AAGACCGC | 4355 |
| 1314 | UACCGGCUC UCUAUGAA | 200 | UUCAUAGA CUGAUGAGGNNNNNNNNCCGAA AGCCGGUA | 4356 |
| 1316 | CCGGCUCUC UAUGAAAG | 201 | CUUUCAUA CUGAUGAGGNNNNNNNNCCGAA AGAGCCGG | 4357 |
| 1318 | GGCUCUCUA UGAAAGUG | 202 | CACUUUCA CUGAUGAGGNNNNNNNNCCGAA AGAGAGCC | 4358 |
| 1334 | GAAGGCAUU UCCCUCGC | 203 | GCGAGGGA CUGAUGAGGNNNNNNNNCCGAA AUGCCUUC | 4359 |
| 1335 | AAGGCAUUU CCCUCGCC | 204 | GGCGAGGG CUGAUGAGGNNNNNNNNCCGAA AAUGCCUU | 4360 |
| 1336 | AGGCAUUUC CCUCGCCG | 205 | CGGCGAGG CUGAUGAGGNNNNNNNNCCGAA AAAUGCCU | 4361 |
| 1340 | AUUUCCCUC GCCGGAAG | 206 | CUUCCGGC CUGAUGAGGNNNNNNNNCCGAA AGGGAAAU | 4362 |
| 1350 | CCGGAAGUU GUAUGGUU | 207 | AACCAUAC CUGAUGAGGNNNNNNNNCCGAA ACUUCCGG | 4363 |
| 1353 | GAAGUUGUA UGGUUAAA | 208 | UUUAACCA CUGAUGAGGNNNNNNNNCCGAA ACAACUUC | 4364 |
| 1358 | UGUAUGGUU AAAGAUG | 209 | CAUCUUUU CUGAUGAGGNNNNNNNNCCGAA ACCAUACA | 4365 |
| 1359 | GUAUGGUUA AAGAUGG | 210 | CCAUCUUU CUGAUGAGGNNNNNNNNCCGAA AACCAUAC | 4366 |
| 1370 | AGAUGGGUU ACCUGCGA | 211 | UCGCAGGU CUGAUGAGGNNNNNNNNCCGAA ACCCAUCU | 4367 |
| 1371 | GAUGGGUUA CCUGCGAC | 212 | GUCGCAGG CUGAUGAGGNNNNNNNNCCGAA AACCCAUC | 4368 |
| 1388 | UGAGAAAUC UGCUCGCU | 213 | AGCGAGCA CUGAUGAGGNNNNNNNNCCGAA AUUUCUCA | 4369 |
| 1393 | AAUCUGCUC GCUAUUUG | 214 | CAAAUAGC CUGAUGAGGNNNNNNNNCCGAA AGCAGAUUU | 4370 |
| 1397 | UGCUCGCUA UUUGACUC | 215 | GAGUCAAA CUGAUGAGGNNNNNNNNCCGAA AGCGAGCA | 4371 |
| 1399 | CUCGCUAUU UGACUCGU | 216 | ACGAGUCA CUGAUGAGGNNNNNNNNCCGAA AUAGCGAG | 4372 |
| 1400 | UCGCUAUUU GACUCGUG | 217 | CACGAGUC CUGAUGAGGNNNNNNNNCCGAA AAUAGCGA | 4373 |
| 1405 | AUUUGACUC GUGGCUAC | 218 | GUAGCCAC CUGAUGAGGNNNNNNNNCCGAA AGUCAAAU | 4374 |
| 1412 | UCGUGGCUA CUCGUUAA | 219 | UUAACGAG CUGAUGAGGNNNNNNNNCCGAA AGCCACGA | 4375 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1415 | UGGCUACUC GUUAAUUA | 220 | UAAUUAAC CUGAUGAGGNNNNNNNNCCGAA AGUAGCCA | 4376 |
| 1418 | CUACUCGUU AAUUAUCA | 221 | UGAUAAUU CUGAUGAGGNNNNNNNNCCGAA ACGAGUAG | 4377 |
| 1419 | UACUCGUUA AUUAUCAA | 222 | UUGAUAAU CUGAUGAGGNNNNNNNNCCGAA AACGAGUA | 4378 |
| 1422 | UCGUUAAUU AUCAAGGA | 223 | UCCUUGAU CUGAUGAGGNNNNNNNNCCGAA AUUAACGA | 4379 |
| 1423 | CGUUAAUUA UCAAGGAC | 224 | GUCCUUGA CUGAUGAGGNNNNNNNNCCGAA AAUUAACG | 4380 |
| 1425 | UUAAUUAUC AAGGACGU | 225 | ACGUCCUU CUGAUGAGGNNNNNNNNCCGAA AUAAUUAA | 4381 |
| 1434 | AAGGACGUA ACUGAAGA | 226 | UCUUCAGU CUGAUGAGGNNNNNNNNCCGAA ACGUCCUU | 4382 |
| 1456 | CAGGGAAUU AUACAAUC | 227 | GAUUGUAU CUGAUGAGGNNNNNNNNCCGAA AUUCCCUG | 4383 |
| 1457 | AGGGAAUUA UACAAUCU | 228 | AGAUUGUA CUGAUGAGGNNNNNNNNCCGAA AAUUCCCU | 4384 |
| 1459 | GGAAUUAUA CAAUCUUG | 229 | CAAGAUUG CUGAUGAGGNNNNNNNNCCGAA AUAAUUCC | 4385 |
| 1464 | UAUACAAUC UUGCUGAG | 230 | CUCAGCAA CUGAUGAGGNNNNNNNNCCGAA AUUGUAUA | 4386 |
| 1466 | UACAAUCUU GCUGAGCA | 231 | UGCUCAGC CUGAUGAGGNNNNNNNNCCGAA AGAUUGUA | 4387 |
| 1476 | CUGAGCAUA AAACAGUC | 232 | GACUGUUU CUGAUGAGGNNNNNNNNCCGAA AUGCUCAG | 4388 |
| 1484 | AAACAGUC AAAUGUGU | 233 | ACACAUUU CUGAUGAGGNNNNNNNNCCGAA ACUGUUUU | 4389 |
| 1493 | AAAUGUGUU UAAAAACC | 234 | GGUUUUUA CUGAUGAGGNNNNNNNNCCGAA ACACAUUU | 4390 |
| 1494 | AAUGUGUUU AAAAACCU | 235 | AGGUUUUU CUGAUGAGGNNNNNNNNCCGAA AACACAUU | 4391 |
| 1495 | AUGUGUUUA AAAACCUC | 236 | GAGGUUUU CUGAUGAGGNNNNNNNNCCGAA AAACACAU | 4392 |
| 1503 | AAAAACCUC ACUGCCAG | 237 | GUGGCAGU CUGAUGAGGNNNNNNNNCCGAA AGGUUUUU | 4393 |
| 1513 | CUGCCACUC UAAUUGUC | 238 | GACAAUUA CUGAUGAGGNNNNNNNNCCGAA AGUGGCAG | 4394 |
| 1515 | GCCACUCUA AUUGUCAA | 239 | UUGACAAU CUGAUGAGGNNNNNNNNCCGAA AGAGUGGC | 4395 |
| 1518 | ACUCUAAUU GUCAAUGU | 240 | ACAUUGAC CUGAUGAGGNNNNNNNNCCGAA AUUAGAGU | 4396 |
| 1521 | CUAAUUGUC AAUGUGAA | 241 | UUCACAUU CUGAUGAGGNNNNNNNNCCGAA ACAAUUAG | 4397 |
| 1539 | CCCCAGAUU UACGAAAA | 242 | UUUUCGUA CUGAUGAGGNNNNNNNNCCGAA AUCUGGGG | 4398 |
| 1540 | CCCAGAUUU ACGAAAAG | 243 | CUUUUCGU CUGAUGAGGNNNNNNNNCCGAA AAUCUGGG | 4399 |
| 1541 | CCAGAUUUA CGAAAAGG | 244 | CCUUUUCG CUGAUGAGGNNNNNNNNCCGAA AAAUCUGG | 4400 |
| 1556 | GGCCGUGUC AUCGUUUC | 245 | GAAACGAU CUGAUGAGGNNNNNNNNCCGAA ACACGGCC | 4401 |
| 1559 | CGUGUCAUC GUUUCCAG | 246 | CUGGAAAC CUGAUGAGGNNNNNNNNCCGAA AUGACACG | 4402 |
| 1562 | GUCAUCGUU CCAGACC | 247 | GGUCUGGA CUGAUGAGGNNNNNNNNCCGAA ACGAUGAC | 4403 |
| 1563 | UCAUCGUUU CCAGACCC | 248 | GGGUCUGG CUGAUGAGGNNNNNNNNCCGAA AACGAUGA | 4404 |
| 1564 | CAUCGUUUC CAGACCCG | 249 | CGGGUCUG CUGAUGAGGNNNNNNNNCCGAA AAACGAUG | 4405 |
| 1576 | ACCCGGCUC UCUACCCA | 250 | UGGGUAGA CUGAUGAGGNNNNNNNNCCGAA AGCCGGGU | 4406 |
| 1578 | CCGGCUCUC UACCCACU | 251 | AGUGGGUA CUGAUGAGGNNNNNNNNCCGAA AGAGCCGG | 4407 |
| 1580 | GGCUCUCUA CCCACUGG | 252 | CCAGUGGG CUGAUGAGGNNNNNNNNCCGAA AGAGAGCC | 4408 |
| 1602 | AGACAAAUC CUGACUUG | 253 | CAAGUCAG CUGAUGAGGNNNNNNNNCCGAA AUUUGUCU | 4409 |
| 1609 | UCCUGACUU GUACGGCA | 254 | UGCCGUAC CUGAUGAGGNNNNNNNNCCGAA AGUCAGGA | 4410 |
| 1612 | UGACUUGUA CCGCAUAU | 255 | AUAUGCGG CUGAUGAGGNNNNNNNNCCGAA ACAAGUCA | 4411 |
| 1619 | UACCGCAUA UGGUAUCC | 256 | GGAUACCA CUGAUGAGGNNNNNNNNCCGAA AUGCGGUA | 4412 |
| 1624 | CAUAUGGUA UCCCUCAA | 257 | UUGAGGGA CUGAUGAGGNNNNNNNNCCGAA ACCAUAUG | 4413 |
| 1626 | UAUGGUAUC CCUACACC | 258 | GGUUGAGG CUGAUGAGGNNNNNNNNCCGAA AUACCAUA | 4414 |
| 1630 | GUAUCCCUC AACCUACA | 259 | UGUAGGUU CUGAUGAGGNNNNNNNNCCGAA AGGGAUAC | 4415 |
| 1636 | CUCAACCUA CAAUCAAG | 260 | CUUGAUUG CUGAUGAGGNNNNNNNNCCGAA AGGUUGAG | 4416 |
| 1641 | CCUACAAUC AAGUGGUU | 261 | AACCACUU CUGAUGAGGNNNNNNNNCCGAA AUUGUAGG | 4417 |
| 1649 | CAAGUGGUU CUGGCACC | 262 | GGUGCCAG CUGAUGAGGNNNNNNNNCCGAA ACCACUUG | 4418 |
| 1650 | AAGUGGUUC UGGCACCC | 263 | GGGUGCCA CUGAUGAGGNNNNNNNNCCGAA AACCACUU | 4419 |
| 1663 | ACCCCUGUA ACCAUAAU | 264 | AUUAUGGU CUGAUGAGGNNNNNNNNCCGAA ACAGGGGU | 4420 |
| 1669 | GUAACCAUA AUCAUUCC | 265 | GGAAUGAU CUGAUGAGGNNNNNNNNCCGAA AUGGUUAC | 4421 |
| 1672 | ACCAUAAUC AUUCCGAA | 266 | UUCGGAAU CUGAUGAGGNNNNNNNNCCGAA AUUAUGGU | 4422 |
| 1675 | AUAAUCAUU CCGAAGCA | 267 | UGCUUCGG CUGAUGAGGNNNNNNNNCCGAA AUGAUUAU | 4423 |
| 1676 | UAAUCAUUC CGAAGCAA | 268 | UUGCUUCG CUGAUGAGGNNNNNNNNCCGAA AAUGAUUA | 4424 |
| 1694 | GUGUGACUU UGUUCCA | 269 | UGGAACAA CUGAUGAGGNNNNNNNNCCGAA AGUCACAC | 4425 |
| 1695 | UGUGACUUU GUUCCAAU | 270 | UUGGAACA CUGAUGAGGNNNNNNNNCCGAA AAGUCACA | 4426 |
| 1696 | GUGACUUUG UUCCAAU | 271 | AUUGGAAC CUGAUGAGGNNNNNNNNCCGAA AAAGUCAC | 4427 |
| 1699 | ACUUUGUU CCAAUAAU | 272 | AUUAUUGG CUGAUGAGGNNNNNNNNCCGAA ACAAAAGU | 4428 |
| 1700 | CUUUUGUUC CAAUAAUG | 273 | CAUUAUUG CUGAUGAGGNNNNNNNNCCGAA AACAAAAG | 4429 |
| 1705 | GUUCCAAUA AUGAAGAG | 274 | CUCUUCAU CUGAUGAGGNNNNNNNNCCGAA AUUGGAAC | 4430 |
| 1715 | UGAAGAGUC UUUAUCC | 275 | GGAUAAGA CUGAUGAGGNNNNNNNNCCGAA ACUCUUCA | 4431 |
| 1718 | AGAGUCCUU UAUCCUGG | 276 | CCAGGAUA CUGAUGAGGNNNNNNNNCCGAA AGGACUCU | 4432 |
| 1719 | GAGUCCUUU AUCCUGGA | 277 | UCCAGGAU CUGAUGAGGNNNNNNNNCCGAA AAGGACUC | 4433 |
| 1720 | AGUCCUUUA UCCUGGAU | 278 | AUCCAGGA CUGAUGAGGNNNNNNNNCCGAA AAAGGACU | 4434 |
| 1722 | UCCUUUAUC CUGGAUGC | 279 | GCAUCCAG CUGAUGAGGNNNNNNNNCCGAA AUAAAGGA | 4435 |
| 1755 | AACAGAAUU GAGAGCAU | 280 | AUGCUCUC CUGAUGAGGNNNNNNNNCCGAA AUUCUGUU | 4436 |
| 1764 | GAGAGCAUC ACUCAGCG | 281 | CGCUGAGU CUGAUGAGGNNNNNNNNCCGAA AUGCUCUC | 4437 |
| 1768 | GCAUCACUC AGCGCAUG | 282 | CAUGCGCU CUGAUGAGGNNNNNNNNCCGAA AGUGAUGC | 4438 |
| 1782 | AUGGCAAUA AUAGAAGG | 283 | CCUUCUAU CUGAUGAGGNNNNNNNNCCGAA AUUGCCAU | 4439 |
| 1785 | GCAAUAAUA GAAGGAAA | 284 | UUUCCUUC CUGAUGAGGNNNNNNNNCCGAA AUUAUUGC | 4440 |
| 1798 | GAAAGAAUA AGAUGGCU | 285 | AGCCAUCU CUGAUGAGGNNNNNNNNCCGAA AUUCUUUC | 4441 |
| 1807 | AGAUGGCUA GCACCUUG | 286 | CAAGGUGC CUGAUGAGGNNNNNNNNCCGAA AGCCAUCU | 4442 |
| 1814 | AGCACCUU GGUGGCUA | 287 | CCACACCA CUGAUGAGGNNNNNNNNCCGAA AGGUGCUA | 4443 |
| 1818 | ACCUUGGUU GUGGCUGA | 288 | UCAGCCAC CUGAUGAGGNNNNNNNNCCGAA ACCAAGGU | 4444 |
| 1829 | GCUGACUC UAGAAUUU | 289 | AAAUUCUA CUGAUGAGGNNNNNNNNCCGAA AGUCAGCC | 4445 |
| 1831 | CUGACUCUA GAAUUUCU | 290 | AGAAAUUC CUGAUGAGGNNNNNNNNCCGAA AGAGUCAG | 4446 |
| 1836 | UCUAGAAUU UCUGGAAU | 291 | AUUCCAGA CUGAUGAGGNNNNNNNNCCGAA AUUCUAGA | 4447 |
| 1837 | CUAGAAUUU CUGGAAUC | 292 | GAUUCCAG CUGAUGAGGNNNNNNNNCCGAA AAUUCUAG | 4448 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 1838 | UAGAAUUUC UGGAAUCU | 293 | AGAUUCCA CUGAUGAGgnnnnnnnnCCGAA AAAUUCUA | 4449 |
| 1845 | UCUGGAAUC UACAUUUG | 294 | CAAAUGUA CUGAUGAGgnnnnnnnnCCGAA AUUCCAGA | 4450 |
| 1847 | UGGAAUCUA CAUUUGCA | 295 | UGCAAAUG CUGAUGAGgnnnnnnnnCCGAA AGAUUCCA | 4451 |
| 1851 | AUCUACAUU UGCAUAGC | 296 | GCUAUGCA CUGAUGAGgnnnnnnnnCCGAA AUGUAGAU | 4452 |
| 1852 | UCUACAUUU GCAUAGCU | 297 | AGCUAUGC CUGAUGAGgnnnnnnnnCCGAA AAUGUAGA | 4453 |
| 1857 | AUUUGCAUA GCUUCCAA | 298 | UUGGAAGC CUGAUGAGgnnnnnnnnCCGAA AUGCAAAU | 4454 |
| 1861 | GCAUAGCUU CCAAUAAA | 299 | UUUAUUGG CUGAUGAGgnnnnnnnnCCGAA AGCUAUGC | 4455 |
| 1862 | CAUAGCUUC CAAUAAAG | 300 | CUUUAUUG CUGAUGAGgnnnnnnnnCCGAA AAGCUAUG | 4456 |
| 1867 | CUUCCAAUA AAGUUGGG | 301 | CCCAACUU CUGAUGAGgnnnnnnnnCCGAA AUUGGAAG | 4457 |
| 1872 | AAUAAAGUU GGGACUGU | 302 | ACAGUCCC CUGAUGAGgnnnnnnnnCCGAA ACUUUAUU | 4458 |
| 1893 | AGAAACAUA AGCUUUUA | 303 | UAAAAGCU CUGAUGAGgnnnnnnnnCCGAA AUGUUUCU | 4459 |
| 1898 | CAUAAGCUU UUAUAUCA | 304 | UGAUAUAA CUGAUGAGgnnnnnnnnCCGAA AGCUUAUG | 4460 |
| 1899 | AUAAGCUUU UAUAUCAC | 305 | GUGAUAUA CUGAUGAGgnnnnnnnnCCGAA AAGCUUAU | 4461 |
| 1900 | UAAGCUUUU AUAUCACA | 306 | UGUGAUAU CUGAUGAGgnnnnnnnnCCGAA AAAGCUUA | 4462 |
| 1901 | AAGCUUUUA UAUCACAG | 307 | CUGUGAUA CUGAUGAGgnnnnnnnnCCGAA AAAAGCUU | 4463 |
| 1903 | GCUUUUAUA UCACAGAU | 308 | AUCUGUGA CUGAUGAGgnnnnnnnnCCGAA AUAAAAGC | 4464 |
| 1905 | UUUUAUAUC ACAGAUGU | 309 | ACAUCUGU CUGAUGAGgnnnnnnnnCCGAA AUAUAAAA | 4465 |
| 1925 | AAAUGGGUU UCAUGUUA | 310 | UAACAUGA CUGAUGAGgnnnnnnnnCCGAA ACCCAUUU | 4466 |
| 1926 | AAUGGGUUU CAUGUUAA | 311 | UUAACAUG CUGAUGAGgnnnnnnnnCCGAA AACCCAUU | 4467 |
| 1927 | AUGGGUUUC AUGUUAAC | 312 | GUUAACAU CUGAUGAGgnnnnnnnnCCGAA AAACCCAU | 4468 |
| 1932 | UUUCAUGUU AACUUGGA | 313 | UCCAAGUU CUGAUGAGgnnnnnnnnCCGAA ACAUGAAA | 4469 |
| 1933 | UUCAUGUUA ACUUGGAA | 314 | UUCCAAGU CUGAUGAGgnnnnnnnnCCGAA AACAUGAA | 4470 |
| 1937 | UGUUAACUU GGAAAAAA | 315 | UUUUUUCC CUGAUGAGgnnnnnnnnCCGAA AGUUAACA | 4471 |
| 1976 | GAAACUGUC UUGCACAG | 316 | CUGUGCAA CUGAUGAGgnnnnnnnnCCGAA ACAGUUUC | 4472 |
| 1978 | AACUGUCUU GCACAGUU | 317 | AACUGUGC CUGAUGAGgnnnnnnnnCCGAA AGACAGUU | 4473 |
| 1986 | UGCACAGUU AACAAGUU | 318 | AACUUGUU CUGAUGAGgnnnnnnnnCCGAA ACUGUGCA | 4474 |
| 1987 | GCACAGUUA ACAAGUUC | 319 | GAACUUGU CUGAUGAGgnnnnnnnnCCGAA AACUGUGC | 4475 |
| 1994 | UAACAAGUU CUUAUACA | 320 | UGUAUAAG CUGAUGAGgnnnnnnnnCCGAA ACUUGUUA | 4476 |
| 1995 | AACAAGUUC UUAUACAG | 321 | CUGUAUAA CUGAUGAGgnnnnnnnnCCGAA AACUUGUU | 4477 |
| 1997 | CAAGUUCUU AUACAGAG | 322 | CUCUGUAU CUGAUGAGgnnnnnnnnCCGAA AGAACUUG | 4478 |
| 1998 | AAGUUCUUA UACAGAGA | 323 | UCUCUGUA CUGAUGAGgnnnnnnnnCCGAA AAGAACUU | 4479 |
| 2000 | GUUCUUAUA CAGAGACG | 324 | CGUCUCUG CUGAUGAGgnnnnnnnnCCGAA AUAAGAAC | 4480 |
| 2010 | AGAGACGUU ACUUGGAU | 325 | AUCCAAGU CUGAUGAGgnnnnnnnnCCGAA ACGUCUCU | 4481 |
| 2011 | GAGACGUUA CUUGGAUU | 326 | AAUCCAAG CUGAUGAGgnnnnnnnnCCGAA AACGUCUC | 4482 |
| 2014 | ACGUUACUU GGAUUUUA | 327 | UAAAAUCC CUGAUGAGgnnnnnnnnCCGAA AGUAACGU | 4483 |
| 2019 | ACUUGGAUU UUACUGCG | 328 | CGCAGUAA CUGAUGAGgnnnnnnnnCCGAA AUCCAAGU | 4484 |
| 2020 | CUUGGAUUU UACUGCGG | 329 | CCGCAGUA CUGAUGAGgnnnnnnnnCCGAA AAUCCAAG | 4485 |
| 2021 | UUGGAUUUU ACUGCGGA | 330 | UCCGCAGU CUGAUGAGgnnnnnnnnCCGAA AAAUCCAA | 4486 |
| 2022 | UGGAUUUUA CUGCGGAC | 331 | GUCCGCAG CUGAUGAGgnnnnnnnnCCGAA AAAAUCCA | 4487 |
| 2034 | CGGACAGUU AAUAACAG | 332 | CUGUUAUU CUGAUGAGgnnnnnnnnCCGAA ACUGUCCG | 4488 |
| 2035 | GGACAGUUA AUAACAGA | 333 | UCUGUUAU CUGAUGAGgnnnnnnnnCCGAA AACUGUCC | 4489 |
| 2038 | CAGUUAAUA ACAGAACA | 334 | UGUUCUGU CUGAUGAGgnnnnnnnnCCGAA AUUAACUG | 4490 |
| 2054 | AAUGCACUA CAGUAUUA | 335 | UAAUACUG CUGAUGAGgnnnnnnnnCCGAA AGUGCAUU | 4491 |
| 2059 | ACUACAGUA UUAGCAAG | 336 | CUUGCUAA CUGAUGAGgnnnnnnnnCCGAA ACUGUAGU | 4492 |
| 2061 | UACAGUAUU AGCAAGCA | 337 | UGCUUGCU CUGAUGAGgnnnnnnnnCCGAA AUACUGUA | 4493 |
| 2062 | ACAGUAUUA GCAAGCAA | 338 | UUGCUUGC CUGAUGAGgnnnnnnnnCCGAA AAUACUGU | 4494 |
| 2082 | AUGGCCAUC ACUAAGGA | 339 | UCCUUAGU CUGAUGAGgnnnnnnnnCCGAA AUGGCCAU | 4495 |
| 2086 | CCAUCACUA AGGAGCAC | 340 | GUGCUCCU CUGAUGAGgnnnnnnnnCCGAA AGUGAUGG | 4496 |
| 2096 | GGAGCACUC CAUCACUC | 341 | GAGUGAUG CUGAUGAGgnnnnnnnnCCGAA AGUGCUCC | 4497 |
| 2100 | CACUCCAUC ACUCUUAA | 342 | UUAAGAGU CUGAUGAGgnnnnnnnnCCGAA AUGGAGUG | 4498 |
| 2104 | CCAUCACUC UUAAUCUU | 343 | AAGAUUAA CUGAUGAGgnnnnnnnnCCGAA AGUGAUGG | 4499 |
| 2106 | AUCACUCUU AAUCUUAC | 344 | GUAAGAUU CUGAUGAGgnnnnnnnnCCGAA AGAGUGAU | 4500 |
| 2107 | UCACUCUUA AUCUUACC | 345 | GGUAAGAU CUGAUGAGgnnnnnnnnCCGAA AAGAGUGA | 4501 |
| 2110 | CUCUUAAUC UUACCAUC | 346 | GAUGGUAA CUGAUGAGgnnnnnnnnCCGAA AUUAAGAG | 4502 |
| 2112 | CUUAAUCUU ACCAUCAU | 347 | AUGAUGGU CUGAUGAGgnnnnnnnnCCGAA AGAUUAAG | 4503 |
| 2113 | UUAAUCUUA CCAUCAUG | 348 | CAUGAUGG CUGAUGAGgnnnnnnnnCCGAA AAGAUUAA | 4504 |
| 2118 | CUUACCAUC AUGAAUGU | 349 | ACAUUCAU CUGAUGAGgnnnnnnnnCCGAA AUGGUAAG | 4505 |
| 2127 | AUGAAUGUU CCCUGCA | 350 | UGCAGGGA CUGAUGAGgnnnnnnnnCCGAA ACAUUCAU | 4506 |
| 2128 | UGAAUGUUU CCCUGCAA | 351 | UUGCAGGG CUGAUGAGgnnnnnnnnCCGAA AACAUUCA | 4507 |
| 2129 | GAAUGUUUC CCUGCAAG | 352 | CUUGCAGG CUGAUGAGgnnnnnnnnCCGAA AAACAUUC | 4508 |
| 2140 | UGCAAGAUU CAGGCACC | 353 | GGUGCCUG CUGAUGAGgnnnnnnnnCCGAA AUCUUGCA | 4509 |
| 2141 | GCAAGAUUC AGGCACCU | 354 | AGGUGCCU CUGAUGAGgnnnnnnnnCCGAA AAUCUUGC | 4510 |
| 2150 | AGGCACCUA UGCCUGCA | 355 | UGCAGGCA CUGAUGAGgnnnnnnnnCCGAA AGGUGCCU | 4511 |
| 2172 | AGGAAUGUA UACACAGG | 356 | CCUGUGUA CUGAUGAGgnnnnnnnnCCGAA ACAUUCCU | 4512 |
| 2174 | GAAUGUAUA CACAGGGG | 357 | CCCCUGUG CUGAUGAGgnnnnnnnnCCGAA AUACAUUC | 4513 |
| 2190 | GAAGAAAUC UCCAGAA | 358 | UUCUGGAG CUGAUGAGgnnnnnnnnCCGAA AUUUCUUC | 4514 |
| 2193 | GAAAUCCUC CAGAAGAA | 359 | UUCUUCUG CUGAUGAGgnnnnnnnnCCGAA AGGAUUUC | 4515 |
| 2208 | AAAGAAAUU ACAACGA | 360 | CUGAUUGU CUGAUGAGgnnnnnnnnCCGAA AUUUCUUU | 4516 |
| 2209 | AAGAAAUUA CAAUCAGA | 361 | UCUGAUUG CUGAUGAGgnnnnnnnnCCGAA AAUUUCUU | 4517 |
| 2214 | AUUACAAUC AGAGAUCA | 362 | UGAUCUCU CUGAUGAGgnnnnnnnnCCGAA AUUGUAAU | 4518 |
| 2221 | UCAGAGAUC AGGAAGCA | 363 | UGCUUCCU CUGAUGAGgnnnnnnnnCCGAA AUCUCUGA | 4519 |
| 2234 | AGCACCAUA CCUCCUGC | 364 | GCAGGAGG CUGAUGAGgnnnnnnnnCCGAA AUGGUGCU | 4520 |
| 2238 | CCAUACCUC CUGCGAAA | 365 | UUUCGCAG CUGAUGAGgnnnnnnnnCCGAA AGGUAUGG | 4521 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 2250 | CGAAACCUC AGUGAUCA | 366 | UGAUCACU CUGAUGAGgNNNNNNNNCCGAA AGGUUUCG | 4522 |
| 2257 | UCAGUGAUC ACACAGUG | 367 | CACUGUGU CUGAUGAGgNNNNNNNNCCGAA AUCACUGA | 4523 |
| 2271 | GUGGCCAUC AGCAGUUC | 368 | GAACUGCU CUGAUGAGgNNNNNNNNCCGAA AUGGCCAC | 4524 |
| 2278 | UCAGCAGUU CCACCACU | 369 | AGUGGUGG CUGAUGAGgNNNNNNNNCCGAA ACUGCUGA | 4525 |
| 2279 | CAGCAGUUC CACCACUU | 370 | AAGUGGUG CUGAUGAGgNNNNNNNNCCGAA AACUGCUG | 4526 |
| 2287 | CCACCACUU UAGACUGU | 371 | ACAGUCUA CUGAUGAGgNNNNNNNNCCGAA AGUGGUGG | 4527 |
| 2288 | CACCACUUU AGACUGUC | 372 | GACAGUCU CUGAUGAGgNNNNNNNNCCGAA AAGUGGUG | 4528 |
| 2289 | ACCACUUUA GACUGUCA | 373 | UGACAGUC CUGAUGAGgNNNNNNNNCCGAA AAAGUGGU | 4529 |
| 2296 | UAGACUGUC AUGCUAAU | 374 | AUUAGCAU CUGAUGAGgNNNNNNNNCCGAA ACAGUCUA | 4530 |
| 2302 | GUCAUGCUA AUGGUGUC | 375 | GACACCAU CUGAUGAGgNNNNNNNNCCGAA AGCAUGAC | 4531 |
| 2310 | AAUGGUGUC CCCGAGCC | 376 | GGCUCGGG CUGAUGAGgNNNNNNNNCCGAA ACACCAUU | 4532 |
| 2320 | CCGAGCCUC AGAUCACU | 377 | AGUGAUCU CUGAUGAGgNNNNNNNNCCGAA AGGCUCGG | 4533 |
| 2325 | CCUCAGAUC ACUUGGUU | 378 | AACCAAGU CUGAUGAGgNNNNNNNNCCGAA AUCUGAGG | 4534 |
| 2329 | AGAUCACUU GGUUUAAA | 379 | UUUAAACC CUGAUGAGgNNNNNNNNCCGAA AGUGAUCU | 4535 |
| 2333 | CACUUGGUU UAAAAACA | 380 | UGUUUUUA CUGAUGAGgNNNNNNNNCCGAA ACCAAGUG | 4536 |
| 2334 | ACUUGGUUU AAAAACAA | 381 | UUGUUUUU CUGAUGAGgNNNNNNNNCCGAA AACCAAGU | 4537 |
| 2335 | CUUGGUUUA AAACAAC | 382 | GUUGUUUU CUGAUGAGgNNNNNNNNCCGAA AAACCAAG | 4538 |
| 2352 | CACAAAAUA CAACAAGA | 383 | UCUUGUUG CUGAUGAGgNNNNNNNNCCGAA AUUUUGUG | 4539 |
| 2370 | CCUGGAAUU AUUUUAGG | 384 | CCUAAAAU CUGAUGAGgNNNNNNNNCCGAA AUUCCAGG | 4540 |
| 2371 | CUGGAAUUA UUUUAGGA | 385 | UCCUAAAA CUGAUGAGgNNNNNNNNCCGAA AAUUCCAG | 4541 |
| 2373 | GGAAUUAUU UUAGGACC | 386 | GGUCCUAA CUGAUGAGgNNNNNNNNCCGAA AUAAUUCC | 4542 |
| 2374 | GAAUUAUUU UAGGACCA | 387 | UGGUCCUA CUGAUGAGgNNNNNNNNCCGAA AAUAAUUC | 4543 |
| 2375 | AAUUAUUUU AGGACCAG | 388 | CUGGUCCU CUGAUGAGgNNNNNNNNCCGAA AAAUAAUU | 4544 |
| 2376 | AUUAUUUUA GGACCAGG | 389 | CCUGGUCC CUGAUGAGgNNNNNNNNCCGAA AAAAUAAU | 4545 |
| 2399 | CACGCUGUU UAUUGAAA | 390 | UUUCAAUA CUGAUGAGgNNNNNNNNCCGAA ACAGCGUG | 4546 |
| 2400 | ACGCUGUUU AUUGAAAG | 391 | CUUUCAAU CUGAUGAGgNNNNNNNNCCGAA AACAGCGU | 4547 |
| 2401 | CGCUGUUUA UUGAAGA | 392 | UCUUUCAA CUGAUGAGgNNNNNNNNCCGAA AAACAGCG | 4548 |
| 2403 | CUGUUUAUU GAAAGAGU | 393 | ACUCUUUC CUGAUGAGgNNNNNNNNCCGAA AUAAACAG | 4549 |
| 2412 | GAAAGAGUC ACAGAAGA | 394 | UCUUCUGU CUGAUGAGgNNNNNNNNCCGAA ACUCUUUC | 4550 |
| 2433 | GAAGGUGUC UAUCACUG | 395 | CAGUGAUA CUGAUGAGgNNNNNNNNCCGAA ACACCUUC | 4551 |
| 2435 | AGGUGUCUA UCACUGCA | 396 | UGCAGUGA CUGAUGAGgNNNNNNNNCCGAA AGACACCU | 4552 |
| 2437 | GUGUCUAUC ACUGCAAA | 397 | UUUGCAGU CUGAUGAGgNNNNNNNNCCGAA AUAGACAC | 4553 |
| 2465 | GAAGGGCUC UGUGGAAA | 398 | UUUCCACA CUGAUGAGgNNNNNNNNCCGAA AGCCCUUC | 4554 |
| 2476 | UGGAAAGUU CAGCAUAC | 399 | GUAUGCUG CUGAUGAGgNNNNNNNNCCGAA ACUUUCCA | 4555 |
| 2477 | GGAAAGUUC AGCAUACC | 400 | GGUAUGCU CUGAUGAGgNNNNNNNNCCGAA AACUUUCC | 4556 |
| 2483 | UUCAGCAUA CCUCACUG | 401 | CAGUGAGG CUGAUGAGgNNNNNNNNCCGAA AUGCUGAA | 4557 |
| 2487 | GCAUACCUC ACUGUUCA | 402 | UGAACAGU CUGAUGAGgNNNNNNNNCCGAA AGGUAUGC | 4558 |
| 2493 | CUCACUGUU CAAGGAAC | 403 | GUUCCUUG CUGAUGAGgNNNNNNNNCCGAA ACAGUGAG | 4559 |
| 2494 | UCACUGUUC AAGGAACC | 404 | GGUUCCUU CUGAUGAGgNNNNNNNNCCGAA AACAGUGA | 4560 |
| 2504 | AGGAACCUC GGACAAGU | 405 | ACUUGUCC CUGAUGAGgNNNNNNNNCCGAA AGGUUCCU | 4561 |
| 2513 | GGACAAGUC UAAUCUGG | 406 | CCAGAUUA CUGAUGAGgNNNNNNNNCCGAA ACUUGUCC | 4562 |
| 2515 | ACAAGUCUA AUCUGGAG | 407 | CUCCAGAU CUGAUGAGgNNNNNNNNCCGAA AGACUUGU | 4563 |
| 2518 | AGUCUAAUC UGGAGCCA | 408 | CAGCUCCA CUGAUGAGgNNNNNNNNCCGAA AUUAGACU | 4564 |
| 2529 | GAGCUGAUC ACUCUAAC | 409 | GUUAGAGU CUGAUGAGgNNNNNNNNCCGAA AUCAGCUC | 4565 |
| 2533 | UGAUCACUC UAACAUGC | 410 | GCAUGUUA CUGAUGAGgNNNNNNNNCCGAA AGUGAUCA | 4566 |
| 2535 | AUCACUCUA ACAUGCAC | 411 | GUGCAUGU CUGAUGAGgNNNNNNNNCCGAA AGAGUGAU | 4567 |
| 2560 | CUGCGACUC UCAGCUGG | 412 | CCAGAUGA CUGAUGAGgNNNNNNNNCCGAA AGUCGCAG | 4568 |
| 2562 | GCGACUCUC UUCUGGCU | 413 | AGCCAGAA CUGAUGAGgNNNNNNNNCCGAA AGAGUCGC | 4569 |
| 2564 | GACUCUCUU CUGGCUCC | 414 | GGAGCCAG CUGAUGAGgNNNNNNNNCCGAA AGAGAGUC | 4570 |
| 2565 | ACUCUCUUC UGGCUCCU | 415 | AGGAGCCA CUGAUGAGgNNNNNNNNCCGAA AAGAGAGU | 4571 |
| 2571 | UUCUGGCUC CUAUUAAC | 416 | GUUAAUAG CUGAUGAGgNNNNNNNNCCGAA AGCCAGAA | 4572 |
| 2574 | UGGCUCCUA UUAACCCU | 417 | AGGGUUAA CUGAUGAGgNNNNNNNNCCGAA AGGAGCCA | 4573 |
| 2576 | GCUCCUAUU AACCCUCC | 418 | GGAGGGUU CUGAUGAGgNNNNNNNNCCGAA AUAGGAGC | 4574 |
| 2577 | CUCCUAUUA ACCCUCCU | 419 | AGGAGGGU CUGAUGAGgNNNNNNNNCCGAA AAUAGGAG | 4575 |
| 2583 | UUAACCCUC CUAUCCG | 420 | CGGAUAAG CUGAUGAGgNNNNNNNNCCGAA AGGGUUAA | 4576 |
| 2586 | ACCCUCCUU AUCCGAAA | 421 | UUUCGGAU CUGAUGAGgNNNNNNNNCCGAA AGGAGGGU | 4577 |
| 2587 | CCCUCCUUA UCCGAAAA | 422 | UUUUCGGA CUGAUGAGgNNNNNNNNCCGAA AAGGAGGG | 4578 |
| 2589 | CUCCUUAUC CGAAAAAU | 423 | AUUUUUCG CUGAUGAGgNNNNNNNNCCGAA AUAAGGAG | 4579 |
| 2606 | GAAAAGGUC UUCUUCUG | 424 | CAGAAGAA CUGAUGAGgNNNNNNNNCCGAA ACCUUUUC | 4580 |
| 2608 | AAAGGUCUU CUUCUGAA | 425 | UUCAGAAG CUGAUGAGgNNNNNNNNCCGAA AGACCUUU | 4581 |
| 2609 | AAGGUCUUC UUCUGAAA | 426 | UUUCAGAA CUGAUGAGgNNNNNNNNCCGAA AAGACCUU | 4582 |
| 2611 | GGUCUUCUU CUGAAAUA | 427 | UAUUUCAG CUGAUGAGgNNNNNNNNCCGAA AGAAGACC | 4583 |
| 2612 | GUCUUCUUC UGAAAUAA | 428 | UUAUUUCA CUGAUGAGgNNNNNNNNCCGAA AAGAAGAC | 4584 |
| 2619 | UCUGAAAUA AAGACUGA | 429 | UCAGUCUU CUGAUGAGgNNNNNNNNCCGAA AUUUCAGA | 4585 |
| 2630 | GACUGACUA CCUAUCAA | 430 | UUGAUAGG CUGAUGAGgNNNNNNNNCCGAA AGUCAGUC | 4586 |
| 2634 | GACUACCUA UCAAUUAU | 431 | AUAAUUGA CUGAUGAGgNNNNNNNNCCGAA AGGUAGUC | 4587 |
| 2636 | CUACCUAUC AAUUAUAA | 432 | UUAUAAUU CUGAUGAGgNNNNNNNNCCGAA AUAGGUAG | 4588 |
| 2640 | CUAUCAAUU AUAAUGGA | 433 | UCCAUUAU CUGAUGAGgNNNNNNNNCCGAA AUUGAUAG | 4589 |
| 2641 | UAUCAAUUA UAAUGGAC | 434 | GUCCAUUA CUGAUGAGgNNNNNNNNCCGAA AAUUGAUA | 4590 |
| 2643 | UCAAUUAUA AUGGACCC | 435 | GGGUCCAU CUGAUGAGgNNNNNNNNCCGAA AUAAUUGA | 4591 |
| 2661 | GAUGAAGUU CCUUUGGA | 436 | UCCAAAGG CUGAUGAGgNNNNNNNNCCGAA ACUUCAUC | 4592 |
| 2662 | AUGAAGUUC CUUUGGAU | 437 | AUCCAAAG CUGAUGAGgNNNNNNNNCCGAA AACUUCAU | 4593 |
| 2665 | AAGUUCCUU GGAUGAG | 438 | CUCAUCCA CUGAUGAGgNNNNNNNNCCGAA AGGAACUU | 4594 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 2666 | AGUUCCUUU GGAUGAGC | 439 | GCUCAUCC CUGAUGAGGNNNNNNNNCCGAA AAGGAACU | 4595 |
| 2688 | GAGCGGCUC CCUUAUGA | 440 | UCAUAAGG CUGAUGAGGNNNNNNNNCCGAA AGCCGCUC | 4596 |
| 2692 | GGCUCCCUU AUGAUGCC | 441 | GGCAUCAU CUGAUGAGGNNNNNNNNCCGAA AGGGAGCC | 4597 |
| 2693 | GCUCCCUUA UGAUGCCA | 442 | UGGCAUCA CUGAUGAGGNNNNNNNNCCGAA AAGGGAGC | 4598 |
| 2714 | GUGGGAGUU UGCCCGGG | 443 | CCCGGGCA CUGAUGAGGNNNNNNNNCCGAA ACUCCCAC | 4599 |
| 2715 | UGGGAGUUU GCCCGGGA | 444 | UCCCGGGC CUGAUGAGGNNNNNNNNCCGAA AACUCCCA | 4600 |
| 2730 | GAGAGACUU AAACUGGG | 445 | CCCAGUUU CUGAUGAGGNNNNNNNNCCGAA AGUCUCUC | 4601 |
| 2731 | AGAGACUUA AACUGGGC | 446 | GCCCAGUU CUGAUGAGGNNNNNNNNCCGAA AAGUCUCU | 4602 |
| 2744 | GGGCAAAUC ACUUGGAA | 447 | UUCCAAGU CUGAUGAGGNNNNNNNNCCGAA AUUUGCCC | 4603 |
| 2748 | AAAUCACUU GGAAGAGG | 448 | CCUCUUCC CUGAUGAGGNNNNNNNNCCGAA AGUGAUUU | 4604 |
| 2761 | GAGGGCUUU UGGAAAA | 449 | UUUUCCAA CUGAUGAGGNNNNNNNNCCGAA AGCCCCUC | 4605 |
| 2762 | AGGGGCUUU UGGAAAAG | 450 | CUUUUCCA CUGAUGAGGNNNNNNNNCCGAA AAGCCCCU | 4606 |
| 2763 | GGGGCUUUU GGAAAAGU | 451 | ACUUUUCC CUGAUGAGGNNNNNNNNCCGAA AAAGCCCC | 4607 |
| 2775 | AAAGUGGUU CAAGCAUC | 452 | GAUGCUUG CUGAUGAGGNNNNNNNNCCGAA ACCACUUU | 4608 |
| 2776 | AAGUGGUUC AAGCAUCA | 453 | UGAUGCUU CUGAUGAGGNNNNNNNNCCGAA AACCACUU | 4609 |
| 2783 | UCAAGCAUC AGCAUUUG | 454 | CAAAUGCU CUGAUGAGGNNNNNNNNCCGAA AUGCUUGA | 4610 |
| 2789 | AUCAGCAUU UGGCAUUA | 455 | UAAUGCCA CUGAUGAGGNNNNNNNNCCGAA AUGCUGAU | 4611 |
| 2790 | UCAGCAUUU GGCAUUAA | 456 | UUAAUGCC CUGAUGAGGNNNNNNNNCCGAA AAUGCUGA | 4612 |
| 2796 | UUUGGCAUU AAGAAAUC | 457 | GAUUUCUU CUGAUGAGGNNNNNNNNCCGAA AUGCCAAA | 4613 |
| 2797 | UUGGCAUUA AGAAAUCA | 458 | UGAUUUCU CUGAUGAGGNNNNNNNNCCGAA AAUGCCAA | 4614 |
| 2804 | UAAGAAAUC ACCUACGU | 459 | ACGUAGGU CUGAUGAGGNNNNNNNNCCGAA AUUUCUUA | 4615 |
| 2809 | AAUCACCUA CGUGCCGG | 460 | CCGGCACG CUGAUGAGGNNNNNNNNCCGAA AGGUGAUU | 4616 |
| 2864 | CAGCGAGUA CAAAGCUC | 461 | GAGCUUUG CUGAUGAGGNNNNNNNNCCGAA ACUCGCUG | 4617 |
| 2872 | ACAAAGCUC UGAUGACU | 462 | AGUCAUCA CUGAUGAGGNNNNNNNNCCGAA AGCUUUGU | 4618 |
| 2886 | ACUGAGCUA AAAAUCUU | 463 | AAGAUUUU CUGAUGAGGNNNNNNNNCCGAA AGCUCAGU | 4619 |
| 2892 | CUAAAAAUC UUGACCCA | 464 | UGGGUCAA CUGAUGAGGNNNNNNNNCCGAA AUUUUUAG | 4620 |
| 2894 | AAAAAUCUU GACCCACA | 465 | UGUGGGUC CUGAUGAGGNNNNNNNNCCGAA AGAUUUUU | 4621 |
| 2904 | ACCCACAUU GGCCACCA | 466 | UGGUGGCC CUGAUGAGGNNNNNNNNCCGAA AUGUGGGU | 4622 |
| 2914 | GCCACCAUC UGAACGUG | 467 | CACGUUCA CUGAUGAGGNNNNNNNNCCGAA AUGGUGGC | 4623 |
| 2925 | AACGUGGUU AACCUGCU | 468 | AGCAGGUU CUGAUGAGGNNNNNNNNCCGAA ACCACGUU | 4624 |
| 2926 | ACGUGGUUA ACCUGCGU | 469 | CAGCAGGU CUGAUGAGGNNNNNNNNCCGAA AACCACGU | 4625 |
| 2962 | GAGGGCCUC UGAUGGUG | 470 | CACCAUCA CUGAUGAGGNNNNNNNNCCGAA AGGCCCUC | 4626 |
| 2973 | AUGGUGAUU GUUGAAUA | 471 | UAUUCAAC CUGAUGAGGNNNNNNNNCCGAA AUCACCAU | 4627 |
| 2976 | GUGAUUGUU GAAUACUG | 472 | CAGUAUUC CUGAUGAGGNNNNNNNNCCGAA ACAAUCAC | 4628 |
| 2981 | UGUUGAAUA CUGCAAAU | 473 | AUUUGCAG CUGAUGAGGNNNNNNNNCCGAA AUUCAACA | 4629 |
| 2990 | CUGCAAAUA UGGAAAUC | 474 | GAUUUCCA CUGAUGAGGNNNNNNNNCCGAA AUUUGCAG | 4630 |
| 2998 | AUGGAAAUC UCUCCAAC | 475 | GUUGGAGA CUGAUGAGGNNNNNNNNCCGAA AUUUCCAU | 4631 |
| 3000 | GGAAAUCUC UCCAACUA | 476 | UAGUUGGA CUGAUGAGGNNNNNNNNCCGAA AGAUUUCC | 4632 |
| 3002 | AAAUCUCUC CAACUACC | 477 | GGUAGUUG CUGAUGAGGNNNNNNNNCCGAA AGAGAUUU | 4633 |
| 3008 | CUCCAACUA CCUCAAGA | 478 | UCUUGAGG CUGAUGAGGNNNNNNNNCCGAA AGUUGGAG | 4634 |
| 3012 | AACUACCUC AAGAGCAA | 479 | UUGCUCUU CUGAUGAGGNNNNNNNNCCGAA AGGUAGUU | 4635 |
| 3029 | ACGUGACUU AUUUUUUC | 480 | GAAAAAAU CUGAUGAGGNNNNNNNNCCGAA AGUCACGU | 4636 |
| 3030 | CGUGACUUA UUUUUCU | 481 | AGAAAAAA CUGAUGAGGNNNNNNNNCCGAA AAGUCACG | 4637 |
| 3032 | UGACUUAUU UUUCUCA | 482 | UGAGAAAA CUGAUGAGGNNNNNNNNCCGAA AUAAGUCA | 4638 |
| 3033 | GACUUAUUU UUUCUCAA | 483 | UUGAGAAA CUGAUGAGGNNNNNNNNCCGAA AAUAAGUC | 4639 |
| 3034 | ACUUAUUUU UUCUCAAC | 484 | GUUGAGAA CUGAUGAGGNNNNNNNNCCGAA AAAUAAGU | 4640 |
| 3035 | CUUAUUUUU UCUCAACA | 485 | UGUUGAGA CUGAUGAGGNNNNNNNNCCGAA AAAAUAAG | 4641 |
| 3036 | UUAUUUUUU CUCAACAA | 486 | UUGUUGAG CUGAUGAGGNNNNNNNNCCGAA AAAAAUAA | 4642 |
| 3037 | UAUUUUUUC UCAACAAG | 487 | CUUGUUGA CUGAUGAGGNNNNNNNNCCGAA AAAAAAUA | 4643 |
| 3039 | UUUUUUCUC AACAAGGA | 488 | UCCUUGUU CUGAUGAGGNNNNNNNNCCGAA AGAAAAAA | 4644 |
| 3057 | GCAGCACUA CACAUGGA | 489 | UCCAUGUG CUGAUGAGGNNNNNNNNCCGAA AGUGCUGC | 4645 |
| 3070 | UGGAGCCUA AGAAAGAA | 490 | UUCUUUCU CUGAUGAGGNNNNNNNNCCGAA AGGCUCCA | 4646 |
| 3120 | CCAAGACUA GAUAGCGU | 491 | ACGCUAUC CUGAUGAGGNNNNNNNNCCGAA AGUCUUGG | 4647 |
| 3124 | GACUAGAUA GCGUCACC | 492 | GGUGACGC CUGAUGAGGNNNNNNNNCCGAA AUCUAGUC | 4648 |
| 3129 | GAUAGCGUC ACCAGCAG | 493 | CUGCUGGU CUGAUGAGGNNNNNNNNCCGAA ACGCUAUC | 4649 |
| 3146 | CGAAAGCUU GCGAGCGG | 494 | AGCUCGCA CUGAUGAGGNNNNNNNNCCGAA AGCUUUCG | 4650 |
| 3147 | GAAAGCUUU GCGAGCUC | 495 | GAGCUCGC CUGAUGAGGNNNNNNNNCCGAA AAGCUUUC | 4651 |
| 3155 | UGCGAGCUC CGGCUUUC | 496 | GAAAGCCG CUGAUGAGGNNNNNNNNCCGAA AGCUCGCA | 4652 |
| 3161 | CUCCGGCUU UCAGGAAG | 497 | CUUCCUGA CUGAUGAGGNNNNNNNNCCGAA AGCCGGAG | 4653 |
| 3162 | UCCGGCUUU CAGGAAGA | 498 | UCUUCCUG CUGAUGAGGNNNNNNNNCCGAA AAGCCGGA | 4654 |
| 3163 | CCGGCUUUC AGGAAGAU | 499 | AUCUUCCU CUGAUGAGGNNNNNNNNCCGAA AAAGCCGG | 4655 |
| 3172 | AGGAAGAUA AAAGUCUG | 500 | CAGACUUU CUGAUGAGGNNNNNNNNCCGAA AUCUUCCU | 4656 |
| 3178 | AUAAAGUC UGAGUGAU | 501 | AUCACUCA CUGAUGAGGNNNNNNNNCCGAA ACUUUUAU | 4657 |
| 3189 | AGUGAUGUU GAGGAAGA | 502 | UCUUCCUC CUGAUGAGGNNNNNNNNCCGAA ACAUCACU | 4658 |
| 3205 | AGGAGGAUU CUGACGGU | 503 | ACCGUCAG CUGAUGAGGNNNNNNNNCCGAA AUCCUCCU | 4659 |
| 3206 | GGAGGAUUC UGACGGUU | 504 | AACCGUCA CUGAUGAGGNNNNNNNNCCGAA AAUCCUCC | 4660 |
| 3214 | CUGACGGUU UCUACAAG | 505 | CUUGUAGA CUGAUGAGGNNNNNNNNCCGAA ACCGUCAG | 4661 |
| 3215 | UGACGGUUU CUACAAGG | 506 | CCUUGUAG CUGAUGAGGNNNNNNNNCCGAA AACCGUCA | 4662 |
| 3216 | GACGGUUUC UACAAGGA | 507 | UCCUUGUA CUGAUGAGGNNNNNNNNCCGAA AAACCGUC | 4663 |
| 3218 | CGGUUUCUA CAAGGAGC | 508 | GCUCCUUG CUGAUGAGGNNNNNNNNCCGAA AGAAACCG | 4664 |
| 3231 | GAGCCCAUC ACUAUGGA | 509 | UCCAUAGU CUGAUGAGGNNNNNNNNCCGAA AUGGGCUC | 4665 |
| 3235 | CCAUCACUA UGGAAGAU | 510 | AUCUUCCA CUGAUGAGGNNNNNNNNCCGAA AGUGAUGG | 4666 |
| 3244 | UGGAAGAUC UGAUUUCU | 511 | AGAAAUCA CUGAUGAGGNNNNNNNNCCGAA AUCUUCCA | 4667 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 3249 | GAUCUGAUU UCUUACAG | 512 | CUGUAAGA CUGAUGAGGNNNNNNNNCCGAA AUCAGAUC | 4668 |
| 3250 | AUCUGAUUU CUUACAGU | 513 | ACUGUAAG CUGAUGAGGNNNNNNNNCCGAA AAUCAGAU | 4669 |
| 3251 | UCUGAUUUC UUACAGUU | 514 | AACUGUAA CUGAUGAGGNNNNNNNNCCGAA AAAUCAGA | 4670 |
| 3253 | UGAUUUCUU ACAGUUUU | 515 | AAAACUGU CUGAUGAGGNNNNNNNNCCGAA AGAAAUCA | 4671 |
| 3254 | GAUUUCUUA CAGUUUUC | 516 | GAAAACUG CUGAUGAGGNNNNNNNNCCGAA AAGAAAUC | 4672 |
| 3259 | CUUACAGUU UUCAAGUG | 517 | CACUUGAA CUGAUGAGGNNNNNNNNCCGAA ACUGUAAG | 4673 |
| 3260 | UUACAGUUU UCAAGUGG | 518 | CCACUUGA CUGAUGAGGNNNNNNNNCCGAA AACUGUAA | 4674 |
| 3261 | UACAGUUUU CAAGUGGC | 519 | GCCACUUG CUGAUGAGGNNNNNNNNCCGAA AAACUGUA | 4675 |
| 3262 | ACAGUUUUC AAGUGGCC | 520 | GGCCACUU CUGAUGAGGNNNNNNNNCCGAA AAAACUGU | 4676 |
| 3284 | CAUGGAGUU CCUGUCUU | 521 | AAGACAGG CUGAUGAGGNNNNNNNNCCGAA ACUCCAUG | 4677 |
| 3285 | AUGGAGUUC CUGUCUUC | 522 | GAAGACAG CUGAUGAGGNNNNNNNNCCGAA AACUCCAU | 4678 |
| 3290 | GUUCCUGUC UUCCAGAA | 523 | UUCUGGAA CUGAUGAGGNNNNNNNNCCGAA ACAGGAAC | 4679 |
| 3292 | UCCUGUCUU CCAGAAAG | 524 | CUUUCUGG CUGAUGAGGNNNNNNNNCCGAA AGACAGGA | 4680 |
| 3293 | CCUGUCUUC CAGAAAGU | 525 | ACUUUCUG CUGAUGAGGNNNNNNNNCCGAA AAGACAGG | 4681 |
| 3306 | AAGUGCAUU CAUCGGGA | 526 | UCCCGAUG CUGAUGAGGNNNNNNNNCCGAA AUGCACUU | 4682 |
| 3307 | AGUGCAUUC AUCGGGAC | 527 | GUCCCGAU CUGAUGAGGNNNNNNNNCCGAA AAUGCACU | 4683 |
| 3310 | GCAUUCAUC GGGACCUG | 528 | CAGGUCCC CUGAUGAGGNNNNNNNNCCGAA AUGAAUGC | 4684 |
| 3333 | AGAAACAUU CUUUAUCU | 529 | GAUAAAGA CUGAUGAGGNNNNNNNNCCGAA AUGUUUCU | 4685 |
| 3334 | GAAACAUUC UUUAUCUG | 530 | AGAUAAAA CUGAUGAGGNNNNNNNNCCGAA AAUGUUUC | 4686 |
| 3336 | AACAUUCUU UAUCUGA | 531 | UCAGAUAA CUGAUGAGGNNNNNNNNCCGAA AGAAUGUU | 4687 |
| 3337 | ACAUUCUUU AUCUGAG | 532 | CUCAGAUA CUGAUGAGGNNNNNNNNCCGAA AAGAAUGU | 4688 |
| 3338 | CAUUCUUUU AUCUGAGA | 533 | UCUCAGAU CUGAUGAGGNNNNNNNNCCGAA AAAGAAUG | 4689 |
| 3339 | AUUCUUUUA UCUGAGAA | 534 | UUCUCAGA CUGAUGAGGNNNNNNNNCCGAA AAAAGAAU | 4690 |
| 3341 | UCUUUUAUC UGAGAACA | 535 | UGUUCUCA CUGAUGAGGNNNNNNNNCCGAA AUAAAAGA | 4691 |
| 3363 | GUGAAGAUU GUGAUUU | 536 | AAAUCACA CUGAUGAGGNNNNNNNNCCGAA AUCUUCAC | 4692 |
| 3364 | UGAAGAUUU GUGAUUUU | 537 | AAAAUCAC CUGAUGAGGNNNNNNNNCCGAA AAUCUUCA | 4693 |
| 3370 | UUUGUGAUU UGGCCUU | 538 | AAGGCCAA CUGAUGAGGNNNNNNNNCCGAA AUCACAAA | 4694 |
| 3371 | UUGUGAUUU GGCCUUG | 539 | CAAGGCCA CUGAUGAGGNNNNNNNNCCGAA AAUCACAA | 4695 |
| 3372 | UGUGAUUUG GCCUUGC | 540 | GCAAGGCC CUGAUGAGGNNNNNNNNCCGAA AAAUCACA | 4696 |
| 3378 | UUUGGCCUU GCCCGGGA | 541 | UCCCGGGC CUGAUGAGGNNNNNNNNCCGAA AGGCCAAA | 4697 |
| 3388 | CCCGGGAUA UUUAUAAG | 542 | CUUAUAAA CUGAUGAGGNNNNNNNNCCGAA AUCCCGGG | 4698 |
| 3390 | CGGGAUAUU UAUAAGAA | 543 | UUCUUAUA CUGAUGAGGNNNNNNNNCCGAA AUAUCCCG | 4699 |
| 3391 | GGGAUAUUU AUAAGAAC | 544 | GUUCUUAU CUGAUGAGGNNNNNNNNCCGAA AAUAUCCC | 4700 |
| 3392 | GGAUAUUUA UAAGAACC | 545 | GGUUCUUA CUGAUGAGGNNNNNNNNCCGAA AAAAUAUCC | 4701 |
| 3394 | AUAUUUAUA AGAACCCC | 546 | GGGGUUCU CUGAUGAGGNNNNNNNNCCGAA AUAAAAUAU | 4702 |
| 3406 | ACCCCGAUU AUGUGAGA | 547 | UCUCACAU CUGAUGAGGNNNNNNNNCCGAA AUCGGGGU | 4703 |
| 3407 | CCCCGAUUA UGUGAGAA | 548 | UUCUCACA CUGAUGAGGNNNNNNNNCCGAA AAUCGGGG | 4704 |
| 3424 | AAGGAGAUA CUCGACUU | 549 | AAGUCGAG CUGAUGAGGNNNNNNNNCCGAA AUCUCCUU | 4705 |
| 3427 | GAGAUACUC GACUUCCU | 550 | AGGAAGUC CUGAUGAGGNNNNNNNNCCGAA AGUAUCUC | 4706 |
| 3432 | ACUCGACUU CCUCUGAA | 551 | UUCAGAGG CUGAUGAGGNNNNNNNNCCGAA AGUCGAGU | 4707 |
| 3433 | CUCGACUUC CUCUGAAA | 552 | UUUCAGAG CUGAUGAGGNNNNNNNNCCGAA AAGUCGAG | 4708 |
| 3436 | GACUUCCUC UGAAAUGG | 553 | CCAUUUCA CUGAUGAGGNNNNNNNNCCGAA AGGAAGUC | 4709 |
| 3451 | GGAUGGCUC CCGAAUCU | 554 | AGAUUCGG CUGAUGAGGNNNNNNNNCCGAA AGCCAUCC | 4710 |
| 3458 | UCCCGAAUC UAUCUUUG | 555 | CAAAGAUA CUGAUGAGGNNNNNNNNCCGAA AUUCGGGA | 4711 |
| 3460 | CCGAAUCUA UCUUUGAC | 556 | GUCAAAGA CUGAUGAGGNNNNNNNNCCGAA AGAUUCGG | 4712 |
| 3462 | GAAUCUAUC UUUGACAA | 557 | UUGUCAAA CUGAUGAGGNNNNNNNNCCGAA AUAGAUUC | 4713 |
| 3464 | AUCUAUCUU UGACAAAA | 558 | UUUUGUCA CUGAUGAGGNNNNNNNNCCGAA AGAUAGAU | 4714 |
| 3465 | UCUAUCUUU GACAAAAU | 559 | AUUUUGUC CUGAUGAGGNNNNNNNNCCGAA AAGAUAGA | 4715 |
| 3474 | GACAAAAUC UACAGCAC | 560 | GUGCUGUA CUGAUGAGGNNNNNNNNCCGAA AUUUUGUC | 4716 |
| 3476 | CAAAAUCUA CAGCACCA | 561 | UGGUGCUG CUGAUGAGGNNNNNNNNCCGAA AGAUUUUG | 4717 |
| 3500 | CGUGGGUC UUACGGAG | 562 | CUCCGUAA CUGAUGAGGNNNNNNNNCCGAA ACCACACG | 4718 |
| 3502 | UGGGUCUU ACGGAGUA | 563 | UACUCCGU CUGAUGAGGNNNNNNNNCCGAA AGACCACA | 4719 |
| 3503 | GUGGUCUUA CGGAGUAU | 564 | AUACUCCG CUGAUGAGGNNNNNNNNCCGAA AAGACCAC | 4720 |
| 3510 | UACGGAGUA UUGCUGUG | 565 | CACAGCAA CUGAUGAGGNNNNNNNNCCGAA ACUCCGUA | 4721 |
| 3512 | CGGAGUAUU GCUGUGGG | 566 | CCCACAGC CUGAUGAGGNNNNNNNNCCGAA AUACUCCG | 4722 |
| 3525 | UGGGAAAUC UUCCCUU | 567 | AAGGGAAG CUGAUGAGGNNNNNNNNCCGAA AUUUCCCA | 4723 |
| 3527 | GGAAAUCUU CUCCUUAG | 568 | CUAAGGAG CUGAUGAGGNNNNNNNNCCGAA AGAUUUCC | 4724 |
| 3528 | GAAAUCUUC UCCUUAGG | 569 | CCUAAGGA CUGAUGAGGNNNNNNNNCCGAA AAGAUUUC | 4725 |
| 3530 | AAUCUUCUC CUUAGGUG | 570 | CACCUAAG CUGAUGAGGNNNNNNNNCCGAA AGAAGAUU | 4726 |
| 3533 | CUUCUCCUU AGGGGGAAG | 571 | ACCCACCU CUGAUGAGGNNNNNNNNCCGAA AGGAGAAG | 4727 |
| 3534 | UUCUCCUUA GGUGGGUC | 572 | GACCCACC CUGAUGAGGNNNNNNNNCCGAA AAGGAGAA | 4728 |
| 3542 | AGGUGGGUC UCCAUACC | 573 | GGUAUGGA CUGAUGAGGNNNNNNNNCCGAA ACCCACCU | 4729 |
| 3544 | GUGGGUCUC CAUACCCA | 574 | UGGGUAUG CUGAUGAGGNNNNNNNNCCGAA AGACCCAC | 4730 |
| 3548 | GUCUCCAUA CCCAGGAG | 575 | CUCCUGGG CUGAUGAGGNNNNNNNNCCGAA AUGGAGAC | 4731 |
| 3558 | CCAGGAGUA CAAAUGGA | 576 | UCCAUUUG CUGAUGAGGNNNNNNNNCCGAA ACUCCUGG | 4732 |
| 3575 | UGAGGACUU UGCAGUC | 577 | GACUGCAA CUGAUGAGGNNNNNNNNCCGAA AGUCCUCA | 4733 |
| 3576 | GAGGACUUU GCAGUCG | 578 | CGACUGCA CUGAUGAGGNNNNNNNNCCGAA AAGUCCUC | 4734 |
| 3577 | AGGACUUUG CAGUCGC | 579 | GCGACUGC CUGAUGAGGNNNNNNNNCCGAA AAAGUCCU | 4735 |
| 3583 | UUUGCAGUC GCCUGAGG | 580 | CCUCAGGC CUGAUGAGGNNNNNNNNCCGAA ACUGCAAA | 4736 |
| 3613 | UGAGAGCUC CUGAGUAC | 581 | GUACUCAG CUGAUGAGGNNNNNNNNCCGAA AGCUCUCA | 4737 |
| 3620 | UCCUGAGUA CUCUACUC | 582 | GAGUAGAG CUGAUGAGGNNNNNNNNCCGAA ACUCAGGA | 4738 |
| 3623 | UGAGUACUC UACUCCUG | 583 | CAGGAGUA CUGAUGAGGNNNNNNNNCCGAA AGUACUCA | 4739 |
| 3625 | AGUACUCUA CUCCUGAA | 584 | UUCAGGAG CUGAUGAGGNNNNNNNNCCGAA AGAGUACU | 4740 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 3628 | ACUCUACUC CUGAAAUC | 585 | GAUUUCAG CUGAUGAGgNNNNNNNNCCGAA AGUAGAGU | 4741 |
| 3636 | CCUGAAAUC UAUCAGAU | 586 | AUCUGAUA CUGAUGAGgNNNNNNNNCCGAA AUUUCAGG | 4742 |
| 3638 | UGAAAUCUA UCAGAUCA | 587 | UGAUCUGA CUGAUGAGgNNNNNNNNCCGAA AGAUUUCA | 4743 |
| 3640 | AAAUCUAUC AGAUCAUG | 588 | CAUGAUCU CUGAUGAGgNNNNNNNNCCGAA AUAGAUUU | 4744 |
| 3645 | UAUCAGAUC AUGCUGGA | 589 | UCCAGCAU CUGAUGAGgNNNNNNNNCCGAA AUCUGAUA | 4745 |
| 3689 | GCCAAGAUU UGCAGAAC | 590 | GUUCUGCA CUGAUGAGgNNNNNNNNCCGAA AUCUUGGC | 4746 |
| 3690 | CCAAGAUUU GCAGAACU | 591 | AGUUCUGC CUGAUGAGgNNNNNNNNCCGAA AAUCUUGG | 4747 |
| 3699 | GCAGAACUU GUGGAAAA | 592 | UUUUCCAC CUGAUGAGgNNNNNNNNCCGAA AGUUCUGC | 4748 |
| 3711 | GAAAAACUA GGUGAUUU | 593 | AAAUCACC CUGAUGAGgNNNNNNNNCCGAA AGUUUUUC | 4749 |
| 3718 | UAGGUGAUU UGCUUCAA | 594 | UUGAAGCA CUGAUGAGgNNNNNNNNCCGAA AUCACCUA | 4750 |
| 3719 | AGGUGAUUU GCUUCAAG | 595 | CUUGAAGC CUGAUGAGgNNNNNNNNCCGAA AAUCACCU | 4751 |
| 3723 | GAUUUGCUU CAAGCAAA | 596 | UUUGCUUG CUGAUGAGgNNNNNNNNCCGAA AGCAAAUC | 4752 |
| 3724 | AUUUGCUUC AAGCAAAU | 597 | AUUUGCUU CUGAUGAGgNNNNNNNNCCGAA AAGCAAAU | 4753 |
| 3735 | GCAAAUGUA CAACAGGA | 598 | UCCUGUUG CUGAUGAGgNNNNNNNNCCGAA ACAUUUGC | 4754 |
| 3748 | AGGAUGGUA AAGACUAC | 599 | GUAGUCUU CUGAUGAGgNNNNNNNNCCGAA ACCAUCCU | 4755 |
| 3755 | UAAAGACUA CAUCCCAA | 600 | UUGGGAUG CUGAUGAGgNNNNNNNNCCGAA AGUCUUUA | 4756 |
| 3759 | GACUACAUC CCAAUCAA | 601 | UUGAUUGG CUGAUGAGgNNNNNNNNCCGAA AUGUAGUC | 4757 |
| 3765 | AUCCCAAUC AAUGCCAU | 602 | AUGGCAUU CUGAUGAGgNNNNNNNNCCGAA AUUGGGAU | 4758 |
| 3774 | AAUGCCAUA CUGACAGG | 603 | CCUGUCAG CUGAUGAGgNNNNNNNNCCGAA AUGGCAUU | 4759 |
| 3787 | CAGGAAAUA GUGGGUUU | 604 | AAACCCAC CUGAUGAGgNNNNNNNNCCGAA AUUUCCUG | 4760 |
| 3794 | UAGUGGGUU UACAUACU | 605 | AGUAUGUA CUGAUGAGgNNNNNNNNCCGAA ACCCACUA | 4761 |
| 3795 | AGUGGGUUU ACAUACUC | 606 | GAGUAUGU CUGAUGAGgNNNNNNNNCCGAA AACCCACU | 4762 |
| 3796 | GUGGGUUUA CAUACUCA | 607 | UGAGUAUG CUGAUGAGgNNNNNNNNCCGAA AAACCCAC | 4763 |
| 3800 | GUUUACAUA CUCAACUC | 608 | GAGUUGAG CUGAUGAGgNNNNNNNNCCGAA AUGUAAAC | 4764 |
| 3803 | UACAUACUC AACUCCUG | 609 | CAGGAGUU CUGAUGAGgNNNNNNNNCCGAA AGUAUGUA | 4765 |
| 3808 | ACUCAACUC CUGCCUUC | 610 | GAAGGCAG CUGAUGAGgNNNNNNNNCCGAA AGUUGAGU | 4766 |
| 3815 | UCCUGCCUU CUCUGAGG | 611 | CCUCAGAG CUGAUGAGgNNNNNNNNCCGAA AGGCAGGA | 4767 |
| 3816 | CCUGCCUUC UCUGAGGA | 612 | UCCUCAGA CUGAUGAGgNNNNNNNNCCGAA AAGGCAGG | 4768 |
| 3818 | UGCCUUCUC UGAGGACU | 613 | AGUCCUCA CUGAUGAGgNNNNNNNNCCGAA AGAAGGCA | 4769 |
| 3827 | UGAGGACUU CUUCAAGG | 614 | CCUUGAAG CUGAUGAGgNNNNNNNNCCGAA AGUCCUCA | 4770 |
| 3828 | GAGGACUUC UUCAAGGA | 615 | UCCUUGAA CUGAUGAGgNNNNNNNNCCGAA AAGUCCUC | 4771 |
| 3830 | GGACUUCUU CAAGGAAA | 616 | UUUCCUUG CUGAUGAGgNNNNNNNNCCGAA AGAAGUCC | 4772 |
| 3831 | GACUUCUUC AAGGAAAG | 617 | CUUUCCUU CUGAUGAGgNNNNNNNNCCGAA AAGAAGUC | 4773 |
| 3841 | AGGAAAGUA UUUCAGCU | 618 | AGCUGAAA CUGAUGAGgNNNNNNNNCCGAA ACUUUCCU | 4774 |
| 3843 | GAAAGUAUU UCAGCUCC | 619 | GGAGCUGA CUGAUGAGgNNNNNNNNCCGAA AUACUUUC | 4775 |
| 3844 | AAAGUAUUU CAGCUCCG | 620 | CGGAGCUG CUGAUGAGgNNNNNNNNCCGAA AAUACUUU | 4776 |
| 3845 | AAGUAUUUC AGCUCCGA | 621 | UCGGAGCU CUGAUGAGgNNNNNNNNCCGAA AAAUACUU | 4777 |
| 3850 | UUUCAGCUC CGAAGUUU | 622 | AAACUUCG CUGAUGAGgNNNNNNNNCCGAA AGCUGAAA | 4778 |
| 3857 | UCCGAAGUU UAAUUCAG | 623 | CUGAAUUA CUGAUGAGgNNNNNNNNCCGAA ACUUCGGA | 4779 |
| 3858 | CCGAAGUUU AAUUCAGG | 624 | CCUGAAUU CUGAUGAGgNNNNNNNNCCGAA AACUUCGG | 4780 |
| 3859 | CGAAGUUUA AUUCAGGA | 625 | UCCUGAAU CUGAUGAGgNNNNNNNNCCGAA AAACUUCG | 4781 |
| 3862 | AGUUUAAUU CAGGAAGC | 626 | GCUUCCUG CUGAUGAGgNNNNNNNNCCGAA AUUAAACU | 4782 |
| 3863 | GUUUAAUUC AGGAAGCU | 627 | AGCUUCCU CUGAUGAGgNNNNNNNNCCGAA AAUUAAAC | 4783 |
| 3872 | AGGAAGCUC UGAUGAUG | 628 | CAUCAUCA CUGAUGAGgNNNNNNNNCCGAA AGCUUCCU | 4784 |
| 3882 | GAUGAUGUC AGAUAUGU | 629 | ACAUAUCU CUGAUGAGgNNNNNNNNCCGAA ACAUCAUC | 4785 |
| 3887 | UGUCAGAUA UGUAAAUG | 630 | CAUUUACA CUGAUGAGgNNNNNNNNCCGAA AUCUGACA | 4786 |
| 3891 | AGAUAUGUA AAUGCUUU | 631 | AAAGCAUU CUGAUGAGgNNNNNNNNCCGAA ACAUAUCU | 4787 |
| 3898 | UAAAUGCUU UCAAGUUC | 632 | GAACUUGA CUGAUGAGgNNNNNNNNCCGAA AGCAUUUA | 4788 |
| 3899 | AAAUGCUUU CAAGUUCA | 633 | UGAACUUG CUGAUGAGgNNNNNNNNCCGAA AAGCAUUU | 4789 |
| 3900 | AAUGCUUUC AAGUUCAU | 634 | AUGAACUU CUGAUGAGgNNNNNNNNCCGAA AAAGCAUU | 4790 |
| 3905 | UUUCAAGUU CAUGAGCC | 635 | GGCUCAUG CUGAUGAGgNNNNNNNNCCGAA ACUUGAAA | 4791 |
| 3906 | UUCAAGUUC AUGAGCCU | 636 | AGGCUCAU CUGAUGAGgNNNNNNNNCCGAA AACUUGAA | 4792 |
| 3924 | GAAAGAAUC AAAACCUU | 637 | AAGGUUUU CUGAUGAGgNNNNNNNNCCGAA AUUCUUUC | 4793 |
| 3932 | CAAAACCUU UGAAGAAC | 638 | GUUCUUCA CUGAUGAGgNNNNNNNNCCGAA AGGUUUUG | 4794 |
| 3933 | AAAACCUUU GAAGAACU | 639 | AGUUCUUC CUGAUGAGgNNNNNNNNCCGAA AAGGUUUU | 4795 |
| 3942 | GAAGAACUU UUACCGAA | 640 | UUCGGUAA CUGAUGAGgNNNNNNNNCCGAA AGUUCUUC | 4796 |
| 3943 | AAGAACUUU UACCGAAU | 641 | AUUCGGUA CUGAUGAGgNNNNNNNNCCGAA AAGUUCUU | 4797 |
| 3944 | AGAACUUUU ACCGAAUG | 642 | CAUUCGGU CUGAUGAGgNNNNNNNNCCGAA AAAGUUCU | 4798 |
| 3945 | GAACUUUUA CCGAAUGC | 643 | GCAUUCGG CUGAUGAGgNNNNNNNNCCGAA AAAAGUUC | 4799 |
| 3959 | UGCCACCUC CAUGUUGG | 644 | CAAACAUG CUGAUGAGgNNNNNNNNCCGAA AGGUGGCA | 4800 |
| 3965 | CUCCAUGUU UGAUGACU | 645 | AGUCAUCA CUGAUGAGgNNNNNNNNCCGAA ACAUGGAG | 4801 |
| 3966 | UCCAUGUUU GAUGACUA | 646 | UAGUCAUC CUGAUGAGgNNNNNNNNCCGAA AACAUGGA | 4802 |
| 3974 | UGAUGACUA CCAGGGCG | 647 | CGCCCUGG CUGAUGAGgNNNNNNNNCCGAA AGUCAUCA | 4803 |
| 3994 | GCAGCACUC UGGCCUGG | 648 | CCAGGCCA CUGAUGAGgNNNNNNNNCCGAA AGUGCUGC | 4804 |
| 3998 | CACUCUGUU GGCCUCUC | 649 | GAGAGGCC CUGAUGAGgNNNNNNNNCCGAA ACAGAGUG | 4805 |
| 4004 | GUUGGCCUC UCCCAUGC | 650 | GCAUGGGA CUGAUGAGgNNNNNNNNCCGAA AGGCCAAC | 4806 |
| 4006 | UGGCCUCUC CAUGCUG | 651 | CAGCAUGG CUGAUGAGgNNNNNNNNCCGAA AGAGGCCA | 4807 |
| 4022 | GAAGCCUUG CACCGGA | 652 | UCCAGGUG CUGAUGAGgNNNNNNNNCCGAA AGCGCUUC | 4808 |
| 4023 | AAGCGCUUC ACCGGAC | 653 | GUCCAGGU CUGAUGAGgNNNNNNNNCCGAA AAGCGCUU | 4809 |
| 4052 | CAAGGCCUC GCUCAAGA | 654 | UCUUGAGC CUGAUGAGgNNNNNNNNCCGAA AGGCCUUG | 4810 |
| 4056 | GCCUCGCUC AAGAUUGA | 655 | UCAAUCUU CUGAUGAGgNNNNNNNNCCGAA AGCGAGGC | 4811 |
| 4062 | CUCAAGAUU GACUUGAG | 656 | CUCAAGUC CUGAUGAGgNNNNNNNNCCGAA AUCUUGAG | 4812 |
| 4067 | GAUUGACUU GAGAGUAA | 657 | UUACUCUC CUGAUGAGgNNNNNNNNCCGAA AGUCAAUC | 4813 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4074 | UUGAGAGUA ACCAGUAA | 658 | UUACUGGU CUGAUGAGGNNNNNNNNCCGAA ACUCUCAA | 4814 |
| 4081 | UAACCAGUA AAAGUAAG | 659 | CUUACUUU CUGAUGAGGNNNNNNNNCCGAA ACUGGUUA | 4815 |
| 4087 | GUAAAAGUA AGGAGUCG | 660 | CGACUCCU CUGAUGAGGNNNNNNNNCCGAA ACUUUUAC | 4816 |
| 4094 | UAAGGAGUC GGGGCUGU | 661 | ACAGCCCC CUGAUGAGGNNNNNNNNCCGAA ACUCCUUA | 4817 |
| 4103 | GGGGCUGUC UGAUGUCA | 662 | UGACAUCA CUGAUGAGGNNNNNNNNCCGAA ACAGCCCC | 4818 |
| 4110 | UCUGAUGUC AGCAGGCC | 663 | GGCCUGCU CUGAUGAGGNNNNNNNNCCGAA ACAUCAGA | 4819 |
| 4123 | GGCCCAGUU UCUGCCAU | 664 | AUGGCAGA CUGAUGAGGNNNNNNNNCCGAA ACUGGGCC | 4820 |
| 4124 | GCCCAGUUU CUGCCAUU | 665 | AAUGGCAG CUGAUGAGGNNNNNNNNCCGAA AACUGGGC | 4821 |
| 4125 | CCCAGUUUC UGCCAUUC | 666 | GAAUGGCA CUGAUGAGGNNNNNNNNCCGAA AAACUGGG | 4822 |
| 4132 | UCUGCCAUU CCAGCUGU | 667 | ACAGCUGG CUGAUGAGGNNNNNNNNCCGAA AUGGCAGA | 4823 |
| 4133 | CUGCCAUUC CAGCUGUG | 668 | CACAGCUG CUGAUGAGGNNNNNNNNCCGAA AAUGGCAG | 4824 |
| 4149 | GGGCACGUC AGCGAAGG | 669 | CCUUCGCU CUGAUGAGGNNNNNNNNCCGAA ACGUGCCC | 4825 |
| 4169 | GCGCAGGUU CACCUACG | 670 | CGUAGGUG CUGAUGAGGNNNNNNNNCCGAA ACCUGCGC | 4826 |
| 4170 | CGCAGGUUC ACCUACGA | 671 | UCGUAGGU CUGAUGAGGNNNNNNNNCCGAA AACCUGCG | 4827 |
| 4175 | GUUCACCUA CGACCACG | 672 | CGUGGUCG CUGAUGAGGNNNNNNNNCCGAA AGGUGAAC | 4828 |
| 4203 | AGGAAAAUC GCGUGCUG | 673 | CAGCACGC CUGAUGAGGNNNNNNNNCCGAA AUUUUCCU | 4829 |
| 4214 | GUGCUGCUC CCCGCCCC | 674 | GGGGCGGG CUGAUGAGGNNNNNNNNCCGAA AGCAGCAC | 4830 |
| 4229 | CCCAGACUA CAACUCGG | 675 | CCGAGUUG CUGAUGAGGNNNNNNNNCCGAA AGUCUGGG | 4831 |
| 4235 | CUACAACUC GGUGGUCC | 676 | GGACCACC CUGAUGAGGNNNNNNNNCCGAA AGUUGUAG | 4832 |
| 4242 | UCGGUGGUC CUGUACUC | 677 | GAGUACAG CUGAUGAGGNNNNNNNNCCGAA ACCACCGA | 4833 |
| 4247 | GGUCCUGUA CUCCACCC | 678 | GGGUGGAG CUGAUGAGGNNNNNNNNCCGAA ACAGGACC | 4834 |
| 4250 | CCUGUACUC CACCCCAC | 679 | GUGGGGUG CUGAUGAGGNNNNNNNNCCGAA AGUACAGG | 4835 |
| 4263 | CCACCCAUC UAGAGUUU | 680 | AAACUCUA CUGAUGAGGNNNNNNNNCCGAA AUGGGUGG | 4836 |
| 4265 | ACCCAUCUA GAGUUUGA | 681 | UCAAACUC CUGAUGAGGNNNNNNNNCCGAA AGAUGGGU | 4837 |
| 4270 | UCUAGAGUU UGACACGA | 682 | UCGUGUCA CUGAUGAGGNNNNNNNNCCGAA ACUCUAGA | 4838 |
| 4271 | CUAGAGUUU GACACGAA | 683 | UUCGUGUC CUGAUGAGGNNNNNNNNCCGAA AACUCUAG | 4839 |
| 4284 | CGAAGCCUU AUUUCUAG | 684 | CUAGAAAU CUGAUGAGGNNNNNNNNCCGAA AGGCUUCG | 4840 |
| 4285 | GAAGCCUUA UUUCUAGA | 685 | UCUAGAAA CUGAUGAGGNNNNNNNNCCGAA AAGGCUUC | 4841 |
| 4287 | AGCCUUAUU UCUAGAAG | 686 | CUUCUAGA CUGAUGAGGNNNNNNNNCCGAA AUAAGGCU | 4842 |
| 4288 | GCCUUAUUU CUAGAAGC | 687 | GCUUCUAG CUGAUGAGGNNNNNNNNCCGAA AAUAAGGC | 4843 |
| 4289 | CCUUAUUUC UAGAAGCA | 688 | UGCUUCUA CUGAUGAGGNNNNNNNNCCGAA AAAUAAGG | 4844 |
| 4291 | UUAUUUCUA GAAGCACA | 689 | UGUGCUUC CUGAUGAGGNNNNNNNNCCGAA AGAAAUAA | 4845 |
| 4305 | ACAUGUGUA UUUAUACC | 690 | GGUAUAAA CUGAUGAGGNNNNNNNNCCGAA ACACAUGU | 4846 |
| 4307 | AUGUGUAUU UAUACCCC | 691 | GGGGUAUA CUGAUGAGGNNNNNNNNCCGAA AUACACAU | 4847 |
| 4308 | UGUGUAUUU AUACCCCA | 692 | GGGGUAUA CUGAUGAGGNNNNNNNNCCGAA AAUACACA | 4848 |
| 4309 | GUGUAUUUA UACCCCAG | 693 | UGGGGGUA CUGAUGAGGNNNNNNNNCCGAA AAAUACAC | 4849 |
| 4311 | GUAUUUAUA CCCCAGGG | 694 | CCUGGGGG CUGAUGAGGNNNNNNNNCCGAA AUAAAUAC | 4850 |
| 4325 | AGGAAACUA GCUUUUGC | 695 | GCAAAAGC CUGAUGAGGNNNNNNNNCCGAA AGUUUCCU | 4851 |
| 4329 | AACUAGCUU UGCCAGUU | 696 | ACUGGCAA CUGAUGAGGNNNNNNNNCCGAA AGCUAGUU | 4852 |
| 4330 | ACUAGCUUU UGCCAGUA | 697 | UACUGGCA CUGAUGAGGNNNNNNNNCCGAA AAGCUAGU | 4853 |
| 4331 | CUAGCUUUU GCCAGUAU | 698 | AUACUGGC CUGAUGAGGNNNNNNNNCCGAA AAAGCUAG | 4854 |
| 4338 | UUGCCAGUA UUAUGCAU | 699 | AUGCAUAA CUGAUGAGGNNNNNNNNCCGAA ACUGGCAA | 4855 |
| 4340 | GCCAGUAUU AUGCAUAU | 700 | AUAUGCAU CUGAUGAGGNNNNNNNNCCGAA AAUACUGGC | 4856 |
| 4341 | CCAGUAUUA UGCAUAUA | 701 | UAUAUGCA CUGAUGAGGNNNNNNNNCCGAA AAUACUGG | 4857 |
| 4347 | UUAUGCAUA UAAGUUUA | 702 | AACUUAUA CUGAUGAGGNNNNNNNNCCGAA AUGCAUAA | 4858 |
| 4349 | AUGCAUAUA UAAGUUUA | 703 | UAAACUUA CUGAUGAGGNNNNNNNNCCGAA AUAUGCAU | 4859 |
| 4351 | GCAUAUAUA AGUUUACA | 704 | UGUAAACU CUGAUGAGGNNNNNNNNCCGAA AUAUAUGC | 4860 |
| 4355 | AUAUAAGUU UACACCUU | 705 | AAGGUGUA CUGAUGAGGNNNNNNNNCCGAA ACUUAUAU | 4861 |
| 4356 | UAUAAGUUU ACACCUUU | 706 | AAAGGUGU CUGAUGAGGNNNNNNNNCCGAA AACUUAUA | 4862 |
| 4357 | AUAAGUUUA CACCUUUA | 707 | UAAAGGUG CUGAUGAGGNNNNNNNNCCGAA AAACUUAU | 4863 |
| 4363 | UUACACCUU UAUCUUUC | 708 | GAAAGAUA CUGAUGAGGNNNNNNNNCCGAA AGGUGUAA | 4864 |
| 4364 | UACACCUUU AUCUUUCC | 709 | GGAAAGAU CUGAUGAGGNNNNNNNNCCGAA AAGGUGUA | 4865 |
| 4365 | ACACCUUUA UCUUUCCA | 710 | UGGAAAGA CUGAUGAGGNNNNNNNNCCGAA AAAGGUGU | 4866 |
| 4367 | ACCUUUAUC UUCCAUG | 711 | CAUGGAAA CUGAUGAGGNNNNNNNNCCGAA AUAAAGGU | 4867 |
| 4369 | CUUUAUCUU UCCAUGGG | 712 | CCCAUGGA CUGAUGAGGNNNNNNNNCCGAA AGAUAAAG | 4868 |
| 4370 | UUUAUCUUU CCAUGGGA | 713 | UCCCAUGG CUGAUGAGGNNNNNNNNCCGAA AAGAUAAA | 4869 |
| 4371 | UUAUCUUUC CAUGGGAG | 714 | CUCCCAUG CUGAUGAGGNNNNNNNNCCGAA AAAGAUAA | 4870 |
| 4389 | CAGCUGCUU UUGUGAU | 715 | AUCACAAA CUGAUGAGGNNNNNNNNCCGAA AGCAGCUG | 4871 |
| 4390 | AGCUGCUUU UUGUGAUU | 716 | AAUCACAA CUGAUGAGGNNNNNNNNCCGAA AAGCAGCU | 4872 |
| 4391 | GCUGCUUUU UGUGAUUU | 717 | AAAUCACA CUGAUGAGGNNNNNNNNCCGAA AAAGCAGC | 4873 |
| 4392 | CUGCUUUUU GUGAUUUU | 718 | AAAAUCAC CUGAUGAGGNNNNNNNNCCGAA AAAAGCAG | 4874 |
| 4398 | UUUGUGAUU UUUUAAUU | 719 | AUUAAAAA CUGAUGAGGNNNNNNNNCCGAA AUCACAAA | 4875 |
| 4399 | UUGUGAUUU UUUAAUAU | 720 | UAUUAAAA CUGAUGAGGNNNNNNNNCCGAA AAUCACAA | 4876 |
| 4400 | UGUGAUUUU UUAAUAGU | 721 | CUAUUAAA CUGAUGAGGNNNNNNNNCCGAA AAAUCACA | 4877 |
| 4401 | GUGAUUUUU UAAUAGUU | 722 | ACUAUUAA CUGAUGAGGNNNNNNNNCCGAA AAAAUCAC | 4878 |
| 4402 | UGAUUUUUU AAUAGUG | 723 | CACUAUUA CUGAUGAGGNNNNNNNNCCGAA AAAAAUCA | 4879 |
| 4403 | GAUUUUUUU AAUAGUGC | 724 | GCACUAUU CUGAUGAGGNNNNNNNNCCGAA AAAAAAUC | 4880 |
| 4404 | AUUUUUAAUA GUGCUUUU | 725 | AGCACUAU CUGAUGAGGNNNNNNNNCCGAA AAAAAAAU | 4881 |
| 4407 | UUUUUAAUA GUGCUUUU | 726 | AAAAGCAC CUGAUGAGGNNNNNNNNCCGAA AUUAAAAA | 4882 |
| 4413 | AUAGUGCUU UUUUUUUU | 727 | AAAAAAAA CUGAUGAGGNNNNNNNNCCGAA AGCACUAU | 4883 |
| 4414 | UAGUGCUUU UUUUUUUU | 728 | AAAAAAAA CUGAUGAGGNNNNNNNNCCGAA AAGCACUA | 4884 |
| 4415 | AGUGCUUUU UUUUUUUG | 729 | CAAAAAAA CUGAUGAGGNNNNNNNNCCGAA AAAGCACU | 4885 |
| 4416 | GUGCUUUUU UUUUUUGA | 730 | UCAAAAAA CUGAUGAGGNNNNNNNNCCGAA AAAAGCAC | 4886 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4417 | UGCUUUUUU UUUUUGAC | 731 | GUCAAAAA CUGAUGAGGNNNNNNNNCCGAA AAAAAGCA | 4887 |
| 4418 | GCUUUUUUU UUUUGACU | 732 | AGUCAAAA CUGAUGAGGNNNNNNNNCCGAA AAAAAAGC | 4888 |
| 4419 | GUUUUUUUU UUUGACUA | 733 | UAGUCAAA CUGAUGAGGNNNNNNNNCCGAA AAAAAAAG | 4889 |
| 4420 | UUUUUUUUU UUGACUAA | 734 | UUAGUCAA CUGAUGAGGNNNNNNNNCCGAA AAAAAAAA | 4890 |
| 4421 | UUUUUUUUU UGACUAAC | 735 | GUUAGUCA CUGAUGAGGNNNNNNNNCCGAA AAAAAAAA | 4891 |
| 4422 | UUUUUUUUU GACUAACA | 736 | UGUUAGUC CUGAUGAGGNNNNNNNNCCGAA AAAAAAAA | 4892 |
| 4427 | UUUUGACUA ACAAGAAU | 737 | AUUCUUGU CUGAUGAGGNNNNNNNNCCGAA AGUCAAAA | 4893 |
| 4438 | AAGAAUGUA ACUCCAGA | 738 | UCUGGAGU CUGAUGAGGNNNNNNNNCCGAA ACAUUCUU | 4894 |
| 4442 | AUGUAACUC CAGAUAGA | 739 | UCUAUCUG CUGAUGAGGNNNNNNNNCCGAA AGUUACAU | 4895 |
| 4448 | CUCCAGAUA GAGAAAUA | 740 | UAUUUCUC CUGAUGAGGNNNNNNNNCCGAA AUCUGGAG | 4896 |
| 4456 | AGAGAAAUA GUGACAAG | 741 | CUUGUCAC CUGAUGAGGNNNNNNNNCCGAA AUUUCUCU | 4897 |
| 4476 | AGAACACUA CUGCUAAA | 742 | UUUAGCAG CUGAUGAGGNNNNNNNNCCGAA AGUGUUCU | 4898 |
| 4482 | CUACUGCUA AAUCCUCA | 743 | UGAGGAUU CUGAUGAGGNNNNNNNNCCGAA AGCAGUAG | 4899 |
| 4486 | UGCUAAAUC CUCAUGUU | 744 | AACAUGAG CUGAUGAGGNNNNNNNNCCGAA AUUUAGCA | 4900 |
| 4489 | UAAAUCCUC AUGUUACU | 745 | AGUAACAU CUGAUGAGGNNNNNNNNCCGAA AGGAUUUA | 4901 |
| 4494 | CCUCAUGUU ACUCAGUG | 746 | CACUGAGU CUGAUGAGGNNNNNNNNCCGAA ACAUGAGG | 4902 |
| 4495 | CUCAUGUUA CUCAGUGU | 747 | ACACUGAG CUGAUGAGGNNNNNNNNCCGAA AACAUGAG | 4903 |
| 4498 | AUGUUACUC AGUGUACU | 748 | CUAACGUG CUGAUGAGGNNNNNNNNCCGAA AGUAACAU | 4904 |
| 4504 | CUCAGUGUU AGAGAAAU | 749 | AUUUCUCU CUGAUGAGGNNNNNNNNCCGAA ACACUGAG | 4905 |
| 4505 | UCAGUGUUA GAGAAAUC | 750 | GAUUUCUC CUGAUGAGGNNNNNNNNCCGAA AACACUGA | 4906 |
| 4513 | AGAGAAAUC CUUCCUAA | 751 | UUAGGAAG CUGAUGAGGNNNNNNNNCCGAA AUUUCUCU | 4907 |
| 4516 | GAAAUCCUU CCUAAACC | 752 | GGUUUAGG CUGAUGAGGNNNNNNNNCCGAA AGGAUUUC | 4908 |
| 4517 | AAAUCCUUC CUAAACCC | 753 | GGGUUUAG CUGAUGAGGNNNNNNNNCCGAA AAGGAUUU | 4909 |
| 4520 | UCCUUCCUA AACCCAAU | 754 | AUUGGGUU CUGAUGAGGNNNNNNNNCCGAA AGGAAGGA | 4910 |
| 4533 | CAAUGACUU CCCUGCUC | 755 | GAGCAGGG CUGAUGAGGNNNNNNNNCCGAA AGUCAUUG | 4911 |
| 4534 | AAUGACUUC CCUGCUCC | 756 | GGAGCAGG CUGAUGAGGNNNNNNNNCCGAA AAGUCAUU | 4912 |
| 4541 | UCCCUGCUC CAACCCCC | 757 | GGGGGUUG CUGAUGAGGNNNNNNNNCCGAA AGCAGGGA | 4913 |
| 4557 | CGCCACCUC AGGGCACG | 758 | CGUGCCCU CUGAUGAGGNNNNNNNNCCGAA AGGUGGCG | 4914 |
| 4576 | GGACCAGUU UGAUUGAG | 759 | CUCAAUCA CUGAUGAGGNNNNNNNNCCGAA ACUGGUCC | 4915 |
| 4577 | GACCAGUUU GAUUGAGG | 760 | CCUCAAUC CUGAUGAGGNNNNNNNNCCGAA AACUGGUC | 4916 |
| 4581 | AGUUUGAUU GAGGAGCU | 761 | AGCUCCUC CUGAUGAGGNNNNNNNNCCGAA AUCAAACU | 4917 |
| 4598 | GCACUGAUC ACCCAAUG | 762 | CAUUGGGU CUGAUGAGGNNNNNNNNCCGAA AUCAGUGC | 4918 |
| 4610 | CAAUGCAUC ACGUACCC | 763 | GGGUACGU CUGAUGAGGNNNNNNNNCCGAA AUGCAUUG | 4919 |
| 4615 | CAUCACGUA CCCCACUG | 764 | CAGUGGGG CUGAUGAGGNNNNNNNNCCGAA ACGUGAUG | 4920 |
| 4664 | AAGCCCGUU AGCCCCAG | 765 | CUGGGGCU CUGAUGAGGNNNNNNNNCCGAA ACGGGCUU | 4921 |
| 4665 | AGCCCGUUA GCCCCAGG | 766 | CCUGGGGC CUGAUGAGGNNNNNNNNCCGAA AACGGGCU | 4922 |
| 4678 | CAGGGGAUC ACUGGCUG | 767 | CAGCCAGU CUGAUGAGGNNNNNNNNCCGAA AUCCCCUG | 4923 |
| 4700 | AGCAACAUC UCGGGAGU | 768 | ACUCCCGA CUGAUGAGGNNNNNNNNCCGAA AUGUUGCU | 4924 |
| 4702 | CAACAUCUC GGGAGUCC | 769 | GGACUCCC CUGAUGAGGNNNNNNNNCCGAA AGAUGUUG | 4925 |
| 4709 | UCGGGAGUC CUCUAGCA | 770 | UGCUAGAG CUGAUGAGGNNNNNNNNCCGAA ACUCCCGA | 4926 |
| 4712 | GGAGUCCUC UAGCAGGC | 771 | GCCUGCUA CUGAUGAGGNNNNNNNNCCGAA AGGACUCC | 4927 |
| 4714 | AGUCCUCUA GCAGGCCU | 772 | AGGCCUGC CUGAUGAGGNNNNNNNNCCGAA AGAGGACU | 4928 |
| 4723 | GCAGGCCUA AGACAUGU | 773 | ACAUGUCU CUGAUGAGGNNNNNNNNCCGAA AGGCCUGC | 4929 |
| 4802 | GAAAGAAUU UGAGACGC | 774 | GCGUCUCA CUGAUGAGGNNNNNNNNCCGAA AUUCUUUC | 4930 |
| 4803 | AAAGAAUUU GAGACGCA | 775 | UGCGUCUC CUGAUGAGGNNNNNNNNCCGAA AAUUCUUU | 4931 |
| 4840 | ACGGGCUC AGCAAUGC | 776 | GCAUUGCU CUGAUGAGGNNNNNNNNCCGAA AGCCCCGU | 4932 |
| 4852 | AAUGCCAUU UCAGUGGC | 777 | GCCACUGA CUGAUGAGGNNNNNNNNCCGAA AUGGCAUU | 4933 |
| 4853 | AUGCCAUUU CAGUGGCU | 778 | AGCCACUG CUGAUGAGGNNNNNNNNCCGAA AAUGGCAU | 4934 |
| 4854 | UGCCAUUUC AGUGGCUU | 779 | AAGCCACU CUGAUGAGGNNNNNNNNCCGAA AAAUGGCA | 4935 |
| 4862 | CAGUGGCUU CCCAGCUC | 780 | GAGCUGGG CUGAUGAGGNNNNNNNNCCGAA AGCCACUG | 4936 |
| 4863 | AGUGGCUUC CCAGCUCU | 781 | AGAGCUGG CUGAUGAGGNNNNNNNNCCGAA AAGCCACU | 4937 |
| 4870 | UCCCAGCUC UGACCCUU | 782 | AAGGGUCA CUGAUGAGGNNNNNNNNCCGAA AGCUGGGA | 4938 |
| 4878 | CUGACCCUU CUACAUUU | 783 | AAAUGUAG CUGAUGAGGNNNNNNNNCCGAA AGGGUCAG | 4939 |
| 4879 | UGACCCUUC UACAUUUG | 784 | CAAAUGUA CUGAUGAGGNNNNNNNNCCGAA AAGGGUCA | 4940 |
| 4881 | ACCCUUCUA CAUUUGAG | 785 | CUCAAAUG CUGAUGAGGNNNNNNNNCCGAA AGAAGGGU | 4941 |
| 4885 | UUCUACAUU UGAGGGCC | 786 | GGCCCUCA CUGAUGAGGNNNNNNNNCCGAA AUGUAGAA | 4942 |
| 4886 | UCUACAUUU GAGGGCCC | 787 | GGGCCCUC CUGAUGAGGNNNNNNNNCCGAA AAUGUAGA | 4943 |
| 4929 | GGGGACAUU UCUGGAU | 788 | AUCCAGAA CUGAUGAGGNNNNNNNNCCGAA AUGUCCCC | 4944 |
| 4930 | GGGACAUUU CUGGAUU | 789 | AAUCCAGA CUGAUGAGGNNNNNNNNCCGAA AAUGUCCC | 4945 |
| 4931 | GGACAUUUC UGGAUUC | 790 | GAAUCCAG CUGAUGAGGNNNNNNNNCCGAA AAAUGUCC | 4946 |
| 4932 | GACAUUUCU GGAUUCU | 791 | AGAAUCCA CUGAUGAGGNNNNNNNNCCGAA AAAAUGUC | 4947 |
| 4938 | UUCUGGAUU CUGGGAGG | 792 | CCUCCCAG CUGAUGAGGNNNNNNNNCCGAA AUCCAGAA | 4948 |
| 4939 | UCUGGAUUC UGGGAGGC | 793 | GCCUCCCA CUGAUGAGGNNNNNNNNCCGAA AAUCCAGA | 4949 |
| 4963 | GGACAAAUA UCUUUUUGG | 794 | AAAAAAGA CUGAUGAGGNNNNNNNNCCGAA AUUUGUCC | 4950 |
| 4965 | ACAAAUAUC UUUUUGG | 795 | CCAAAAAA CUGAUGAGGNNNNNNNNCCGAA AUAUUUGU | 4951 |
| 4967 | AAAUAUCUU UUUGGAA | 796 | UUCCAAAA CUGAUGAGGNNNNNNNNCCGAA AGAUAUUU | 4952 |
| 4968 | AAUAUCUUU UUGGAAC | 797 | GUUCCAAA CUGAUGAGGNNNNNNNNCCGAA AAGAUAUU | 4953 |
| 4969 | AUAUCUUUU UUGGAACU | 798 | AGUUCCAA CUGAUGAGGNNNNNNNNCCGAA AAAGAUAU | 4954 |
| 4970 | UAUCUUUUU UGGAACUA | 799 | UAGUUCCA CUGAUGAGGNNNNNNNNCCGAA AAAAGAUA | 4955 |
| 4971 | AUCUUUUUU GGAACUAA | 800 | UUAGUUCC CUGAUGAGGNNNNNNNNCCGAA AAAAAGAU | 4956 |
| 4978 | UUGGAACUA AAGCAAAU | 801 | AUUUGCUU CUGAUGAGGNNNNNNNNCCGAA AGUUCCAA | 4957 |
| 4987 | AAGCAAAUU UUAGACCU | 802 | AGGUCUAA CUGAUGAGGNNNNNNNNCCGAA AUUUGCUU | 4958 |
| 4988 | AGCAAAUUU UAGACCUU | 803 | AAGGUCUA CUGAUGAGGNNNNNNNNCCGAA AAUUUGCU | 4959 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 4989 | GCAAAUUUU AGACCUUU | 804 | AAAGGUCU CUGAUGAGGNNNNNNNNCCGAA AAAUUUGC | 4960 |
| 4990 | CAAAUUUUA GACCUUUA | 805 | UAAAGGUC CUGAUGAGGNNNNNNNNCCGAA AAAAUUUG | 4961 |
| 4996 | UUAGACCUU UACCUAUG | 806 | CAUAGGUA CUGAUGAGGNNNNNNNNCCGAA AGGUCUAA | 4962 |
| 4997 | UAGACCUUU ACCUAUGG | 807 | CCAUAGGU CUGAUGAGGNNNNNNNNCCGAA AAGGUCUA | 4963 |
| 4998 | AGACCUUUA CCUAUGGA | 808 | UCCAUAGG CUGAUGAGGNNNNNNNNCCGAA AAAGGUCU | 4964 |
| 5002 | CUUUACCUA UGGAAGUG | 809 | CACUUCCA CUGAUGAGGNNNNNNNNCCGAA AGGUAAAG | 4965 |
| 5013 | GAAGUGGUU CUAUGUCC | 810 | GGAGAUAG CUGAUGAGGNNNNNNNNCCGAA ACCACUUC | 4966 |
| 5014 | AAGUGGUUC UAUGUCCA | 811 | UGGACAUA CUGAUGAGGNNNNNNNNCCGAA AACCACUU | 4967 |
| 5016 | GUGGUUCUA UGUCCAUU | 812 | AAUGGACA CUGAUGAGGNNNNNNNNCCGAA AGAACCAC | 4968 |
| 5020 | UUCUAUGUC CAUUCUCA | 813 | UGAGAAUG CUGAUGAGGNNNNNNNNCCGAA ACAUAGAA | 4969 |
| 5024 | AUGUCCAUU CUCAUUCG | 814 | CGAAUGAG CUGAUGAGGNNNNNNNNCCGAA AUGGACAU | 4970 |
| 5025 | UGUCCAUUC UCAUUCGU | 815 | ACGAAUGA CUGAUGAGGNNNNNNNNCCGAA AAUGGACA | 4971 |
| 5027 | UCCAUUCUC AUUCGUGG | 816 | CCACGAAU CUGAUGAGGNNNNNNNNCCGAA AGAAUGGA | 4972 |
| 5030 | AUUCUCAUU CGUGGCAU | 817 | AUGCCACG CUGAUGAGGNNNNNNNNCCGAA AUGAGAAU | 4973 |
| 5031 | UUCUCAUUC GUGGCAUG | 818 | CAUGCCAC CUGAUGAGGNNNNNNNNCCGAA AAUGAGAA | 4974 |
| 5041 | UGGCAUGUU UUGAUUUG | 819 | CAAAUCAA CUGAUGAGGNNNNNNNNCCGAA ACAUGCCA | 4975 |
| 5042 | GGCAUGUUU UGAUUUGU | 820 | ACAAAUCA CUGAUGAGGNNNNNNNNCCGAA AACAUGCC | 4976 |
| 5043 | GCAUGUUUU GAUUUGUA | 821 | UACAAAUC CUGAUGAGGNNNNNNNNCCGAA AAACAUGC | 4977 |
| 5047 | GUUUGAUUU GUAGCAC | 822 | GUGCUACA CUGAUGAGGNNNNNNNNCCGAA AUCAAAAC | 4978 |
| 5048 | UUUUGAUUU GUAGCACU | 823 | AGUGCUAC CUGAUGAGGNNNNNNNNCCGAA AAUCAAAA | 4979 |
| 5051 | UGAUUUGUA GCACUGAG | 824 | CUCAGUGC CUGAUGAGGNNNNNNNNCCGAA ACAAAUCA | 4980 |
| 5069 | GUGGCACUC AACUCUGA | 825 | UCAGAGUU CUGAUGAGGNNNNNNNNCCGAA AGUGCCAC | 4981 |
| 5074 | ACUCAACUC UGAGCCCA | 826 | UGGGCUCA CUGAUGAGGNNNNNNNNCCGAA AGUUGAGU | 4982 |
| 5084 | GAGCCCAUA CUUUUGGC | 827 | GCCAAAAG CUGAUGAGGNNNNNNNNCCGAA AUGGGCUC | 4983 |
| 5087 | CCCAUACUU UUGGCUCC | 828 | GGAGCCAA CUGAUGAGGNNNNNNNNCCGAA AGUAUGGG | 4984 |
| 5088 | CCAUACUUU UGGCUCCU | 829 | AGGAGCCA CUGAUGAGGNNNNNNNNCCGAA AAGUAUGG | 4985 |
| 5089 | CAUACUUUU GGCUCCUC | 830 | GAGGAGCC CUGAUGAGGNNNNNNNNCCGAA AAAGUAUG | 4986 |
| 5094 | UUUUGGCUC CUCUAGUA | 831 | UACUAGAG CUGAUGAGGNNNNNNNNCCGAA AGCCAAAA | 4987 |
| 5097 | UGGCUCCUC UAGUAAGA | 832 | UCUUACUA CUGAUGAGGNNNNNNNNCCGAA AGGAGCCA | 4988 |
| 5099 | GCUCCUCUA GUAAGAUG | 833 | CAUCUUAC CUGAUGAGGNNNNNNNNCCGAA AGAGGAGC | 4989 |
| 5102 | CCUCUAGUA AGAUGCAC | 834 | GUGCAUCU CUGAUGAGGNNNNNNNNCCGAA ACUAGAGG | 4990 |
| 5119 | UGAAAACUU AGCCAGAG | 835 | CUCUGGCU CUGAUGAGGNNNNNNNNCCGAA AGUUUUCA | 4991 |
| 5120 | GAAAACUUA GCCAGAGU | 836 | ACUCUGGC CUGAUGAGGNNNNNNNNCCGAA AAGUUUUC | 4992 |
| 5129 | GCCAGAGUU AGGUUGUC | 837 | GACAACCU CUGAUGAGGNNNNNNNNCCGAA ACUCUGGC | 4993 |
| 5130 | CCAGAGUUA GGUUGUCU | 838 | AGACAACC CUGAUGAGGNNNNNNNNCCGAA AACUCUGG | 4994 |
| 5134 | AGUUAGGUU GUCCCAG | 839 | CUGGAGAC CUGAUGAGGNNNNNNNNCCGAA ACCUAACU | 4995 |
| 5137 | UAGGUUGUC UCCAGGCC | 840 | GGCCUGGA CUGAUGAGGNNNNNNNNCCGAA ACAACCUA | 4996 |
| 5139 | GGUUGUCUC CAGGCCAU | 841 | AUGGCCUG CUGAUGAGGNNNNNNNNCCGAA AGACAACC | 4997 |
| 5156 | GAUGGCCUU ACACUGAA | 842 | UUCAGUGU CUGAUGAGGNNNNNNNNCCGAA AGGCCAUC | 4998 |
| 5157 | AUGGCCUUA CACUGAAA | 843 | UUUCAGUG CUGAUGAGGNNNNNNNNCCGAA AAGGCCAU | 4999 |
| 5170 | GAAAAUGUC ACAUUCUA | 844 | UAGAAUGU CUGAUGAGGNNNNNNNNCCGAA ACAUUUUC | 5000 |
| 5175 | UGUCACAUU CUAUUUUG | 845 | CAAAAUAG CUGAUGAGGNNNNNNNNCCGAA AUGUGACA | 5001 |
| 5176 | GUCACAUUC UAUUUUGG | 846 | CCAAAAUA CUGAUGAGGNNNNNNNNCCGAA AAUGUGAC | 5002 |
| 5178 | CACAUUCUA UUUUGGGU | 847 | ACCCAAAA CUGAUGAGGNNNNNNNNCCGAA AGAAUGUG | 5003 |
| 5180 | CAUUCUAUU UUGGGUAU | 848 | AUACCCAA CUGAUGAGGNNNNNNNNCCGAA AUAGAAUG | 5004 |
| 5181 | AUUCUAUUU UGGGUAUU | 849 | AAUACCCA CUGAUGAGGNNNNNNNNCCGAA AAUAGAAU | 5005 |
| 5182 | UUCUAUUUU GGGUAUUA | 850 | UAAUACCC CUGAUGAGGNNNNNNNNCCGAA AAAAUAGAA | 5006 |
| 5187 | UUUUGGGUA UUAAUAUA | 851 | UAUAUUAA CUGAUGAGGNNNNNNNNCCGAA ACCCAAAA | 5007 |
| 5189 | UUGGGUAUU AAUAUAUA | 852 | UAUAUAUU CUGAUGAGGNNNNNNNNCCGAA AUACCCAA | 5008 |
| 5190 | UGGGUAUUA AUAUAUAG | 853 | CUAUAUAU CUGAUGAGGNNNNNNNNCCGAA AAUACCCA | 5009 |
| 5193 | GUAUUAAUA UAUAGUCC | 854 | GGACUAUA CUGAUGAGGNNNNNNNNCCGAA AUUAAUAC | 5010 |
| 5195 | AUUAAUAUA UAGUCCAG | 855 | CUGGACUA CUGAUGAGGNNNNNNNNCCGAA AUAUUAAU | 5011 |
| 5197 | UAAUAUAUA GUCCAGAC | 856 | GUCUGGAC CUGAUGAGGNNNNNNNNCCGAA AUAUAUUA | 5012 |
| 5200 | UAUAUAGUC CAGACACU | 857 | AGUGUCUG CUGAUGAGGNNNNNNNNCCGAA ACUAUAUA | 5013 |
| 5209 | CAGACACUU AACUCAAU | 858 | AUUGAGUU CUGAUGAGGNNNNNNNNCCGAA AGUGUCUG | 5014 |
| 5210 | AGACACUUA ACUCAAUU | 859 | AAUUGAGU CUGAUGAGGNNNNNNNNCCGAA AAGUGUCU | 5015 |
| 5214 | ACUUAACUC AAUUUCUU | 860 | AAGAAAUU CUGAUGAGGNNNNNNNNCCGAA AGUUAAGU | 5016 |
| 5218 | AACUCAAUU UCUUGGUA | 861 | UACCAAGA CUGAUGAGGNNNNNNNNCCGAA AUUGAGUU | 5017 |
| 5219 | ACUCAAUUU CUUGGUAU | 862 | AUACCAAG CUGAUGAGGNNNNNNNNCCGAA AAUUGAGU | 5018 |
| 5220 | CUCAAUUUC UUGGUAUU | 863 | AAUACCAA CUGAUGAGGNNNNNNNNCCGAA AAAUUGAG | 5019 |
| 5222 | CAAUUUCUU GGUAUUAU | 864 | AUAAUACC CUGAUGAGGNNNNNNNNCCGAA AGAAAUUG | 5020 |
| 5226 | UUCUUGGUA UUAUCUG | 865 | CAGAAUAA CUGAUGAGGNNNNNNNNCCGAA ACCAAGAA | 5021 |
| 5228 | CUUGGUAUU AUUCUGUU | 866 | AACAGAAU CUGAUGAGGNNNNNNNNCCGAA AUACCAAG | 5022 |
| 5229 | UUGGUAUUA UUCUGUUU | 867 | AAACAGAA CUGAUGAGGNNNNNNNNCCGAA AAUACCAA | 5023 |
| 5231 | GGUAUUAUU CUGUUUUG | 868 | CAAAACAG CUGAUGAGGNNNNNNNNCCGAA AUAAUACC | 5024 |
| 5232 | GUAUUAUUC UGUUUUGC | 869 | GCAAAACA CUGAUGAGGNNNNNNNNCCGAA AAUAAUAC | 5025 |
| 5236 | UAUUCUGUU UUGCACAG | 870 | CUGUGCAA CUGAUGAGGNNNNNNNNCCGAA ACAGAAUA | 5026 |
| 5237 | AUUCUGUUU UGCACAGU | 871 | ACUGUGCA CUGAUGAGGNNNNNNNNCCGAA AACAGAAU | 5027 |
| 5238 | UUCUGUUUU GCACAGUU | 872 | AACUGUGC CUGAUGAGGNNNNNNNNCCGAA AAACAGAA | 5028 |
| 5246 | UGCACAGUU AGUUGUGA | 873 | UCACAACU CUGAUGAGGNNNNNNNNCCGAA ACUGUGCA | 5029 |
| 5247 | GCACAGUUA GUUGUGAA | 874 | UUCACAAC CUGAUGAGGNNNNNNNNCCGAA AACUGUGC | 5030 |
| 5250 | CAGUUAGUU GUGAAAGA | 875 | UCUUUCAC CUGAUGAGGNNNNNNNNCCGAA ACUAACUG | 5031 |
| 5284 | AAUGCAGUC UGAGGAG | 876 | CUCCUCAG CUGAUGAGGNNNNNNNNCCGAA ACUGCAUU | 5032 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5296 | AGGAGAGUU UUCUCCAU | 877 | AUGGAGAA CUGAUGAGGNNNNNNNNCCGAA ACUCUCCU | 5033 |
| 5297 | GGAGAGUUU UCUCCAUA | 878 | UAUGGAGA CUGAUGAGGNNNNNNNNCCGAA AACUCUCC | 5034 |
| 5298 | GAGAGUUUU CUCCAUAU | 879 | AUAUGGAG CUGAUGAGGNNNNNNNNCCGAA AAACUCUC | 5035 |
| 5299 | AGAGUUUUC UCCAUAUC | 880 | GAUAUGGA CUGAUGAGGNNNNNNNNCCGAA AAAACUCU | 5036 |
| 5301 | AGUUUUCUC CAUAUCAA | 881 | UUGAUAUG CUGAUGAGGNNNNNNNNCCGAA AGAAAACU | 5037 |
| 5305 | UUCUCCAUA UCAAAACG | 882 | CGUUUUGA CUGAUGAGGNNNNNNNNCCGAA AUGGAGAA | 5038 |
| 5307 | CUCCAUAUC AAAACGAG | 883 | CUCGUUUU CUGAUGAGGNNNNNNNNCCGAA AUAUGGAG | 5039 |
| 5336 | AAAAAGGUC AAUAAGGU | 884 | ACCUUAUU CUGAUGAGGNNNNNNNNCCGAA ACCUUUUU | 5040 |
| 5340 | AGGUCAAUA AGGUCAAG | 885 | CUUGACCU CUGAUGAGGNNNNNNNNCCGAA AUUGACCU | 5041 |
| 5345 | AAUAAGGUC AAGGGAAA | 886 | CUUCCCUU CUGAUGAGGNNNNNNNNCCGAA ACCUUAUU | 5042 |
| 5361 | GACCCCGUC UCUAUACC | 887 | GGUAUAGA CUGAUGAGGNNNNNNNNCCGAA ACGGGGUC | 5043 |
| 5363 | CCCCGUCUC UAUACCAA | 888 | UUGGUAUA CUGAUGAGGNNNNNNNNCCGAA AGACGGGG | 5044 |
| 5365 | CCGUCUCUA UACCAACC | 889 | GGUUGGUA CUGAUGAGGNNNNNNNNCCGAA AGAGACGG | 5045 |
| 5367 | GUCUCUAUA CCAACCAA | 890 | UUGGUUGG CUGAUGAGGNNNNNNNNCCGAA AUAGAGAC | 5046 |
| 5382 | AAACCAAUU CACCAACA | 891 | UGUUGGUG CUGAUGAGGNNNNNNNNCCGAA AUUGGUUU | 5047 |
| 5383 | AACCAAUUC ACCAACAC | 892 | GUGUUGGU CUGAUGAGGNNNNNNNNCCGAA AAUUGGUU | 5048 |
| 5395 | AACACAGUU GGACCCA | 893 | UGGGUCCC CUGAUGAGGNNNNNNNNCCGAA ACUGUGUU | 5049 |
| 5417 | CAGGAAGUC AGUCACGU | 894 | ACGUGACU CUGAUGAGGNNNNNNNNCCGAA ACUUCCUG | 5050 |
| 5421 | AAGUCAGUC ACGUUUCC | 895 | GGAAACGU CUGAUGAGGNNNNNNNNCCGAA ACUGACUU | 5051 |
| 5426 | AGUCACGUU UCCUUUUC | 896 | GAAAAGGA CUGAUGAGGNNNNNNNNCCGAA ACGUGACU | 5052 |
| 5427 | GUCACGUUU CCUUUUCA | 897 | UGAAAAGG CUGAUGAGGNNNNNNNNCCGAA AACGUGAC | 5053 |
| 5428 | UCACGUUUC CUUUUCAU | 898 | AUGAAAAG CUGAUGAGGNNNNNNNNCCGAA AAACGUGA | 5054 |
| 5431 | CGUUCCUU UUCAUUUA | 899 | UAAAUGAA CUGAUGAGGNNNNNNNNCCGAA AGGAAACG | 5055 |
| 5432 | GUUUCCUUU UCAUUUAA | 900 | UUAAAUGA CUGAUGAGGNNNNNNNNCCGAA AAGGAAAC | 5056 |
| 5433 | UUUCCUUUU CAUUUAAU | 901 | AUUAAAUG CUGAUGAGGNNNNNNNNCCGAA AAAGGAAA | 5057 |
| 5434 | UUCCUUUUC AUUUAAUG | 902 | CAUUAAAU CUGAUGAGGNNNNNNNNCCGAA AAAAGGAA | 5058 |
| 5437 | CUUUUCAUU UAAUGGGG | 903 | CCCCAUUA CUGAUGAGGNNNNNNNNCCGAA AUGAAAAG | 5059 |
| 5438 | UUUUCAUUU AAUGGGGA | 904 | UCCCCAUU CUGAUGAGGNNNNNNNNCCGAA AAUGAAAA | 5060 |
| 5439 | UUUCAUUUA AUGGGGAU | 905 | AUCCCCAU CUGAUGAGGNNNNNNNNCCGAA AAAUGAAA | 5061 |
| 5448 | AUGGGGAUU CCACUAUC | 906 | GAUAGUGG CUGAUGAGGNNNNNNNNCCGAA AUCCCCAU | 5062 |
| 5449 | UGGGGAUUC CACUAUCU | 907 | AGAUAGUG CUGAUGAGGNNNNNNNNCCGAA AAUCCCCA | 5063 |
| 5454 | AUUCCACUA UCUCACAC | 908 | GUGUGAGA CUGAUGAGGNNNNNNNNCCGAA AGUGGAAU | 5064 |
| 5456 | UCCACUAUC UCACACUA | 909 | UAGUGUGA CUGAUGAGGNNNNNNNNCCGAA AUAGUGGA | 5065 |
| 5458 | CACUAUCUC ACACUAAU | 910 | AUUAGUGU CUGAUGAGGNNNNNNNNCCGAA AGAUAGUG | 5066 |
| 5464 | CUCACACUA AUCUGAAA | 911 | UUUCAGAU CUGAUGAGGNNNNNNNNCCGAA AGUGUGAG | 5067 |
| 5467 | ACACUAAUC UGAAAGGA | 912 | UCCUUUCA CUGAUGAGGNNNNNNNNCCGAA AUUAGUGU | 5068 |
| 5489 | AAGAGCAUU AGCUGGCG | 913 | CGCCAGCU CUGAUGAGGNNNNNNNNCCGAA AUGCUCUU | 5069 |
| 5490 | AGAGCAUUA GCUGGCGC | 914 | GCGCCAGC CUGAUGAGGNNNNNNNNCCGAA AAUGCUCU | 5070 |
| 5501 | UGGCGCAUA UUAAGCCA | 915 | GUGCUUAA CUGAUGAGGNNNNNNNNCCGAA AUGCGCCA | 5071 |
| 5503 | GCGCAUAUU AAGCACUU | 916 | AAGUGCUU CUGAUGAGGNNNNNNNNCCGAA AUAUGCGC | 5072 |
| 5504 | CGCAUAUUA AGCACUUU | 917 | AAAGUGCU CUGAUGAGGNNNNNNNNCCGAA AAUAUGCG | 5073 |
| 5511 | UAAGCACUU AAGCUCC | 918 | GGAGCUUA CUGAUGAGGNNNNNNNNCCGAA AGUGCUUA | 5074 |
| 5512 | AAGCACUUU AAGCUCCU | 919 | AGGAGCUU CUGAUGAGGNNNNNNNNCCGAA AAGUGCUU | 5075 |
| 5513 | AGCACUUUA AGCUCCUU | 920 | AAGGAGCU CUGAUGAGGNNNNNNNNCCGAA AAAGUGCU | 5076 |
| 5518 | UUUAAGCUC CUUGAGUA | 921 | UACUCAAG CUGAUGAGGNNNNNNNNCCGAA AGCUUAAA | 5077 |
| 5521 | AAGCUCCUU GAGUAAAA | 922 | UUUUACUC CUGAUGAGGNNNNNNNNCCGAA AGGAGCUU | 5078 |
| 5526 | CCUUGAGUA AAAGGUG | 923 | CACCUUUU CUGAUGAGGNNNNNNNNCCGAA ACUCAAGG | 5079 |
| 5537 | AAGGUGGUA UGUAAUUU | 924 | AAAUUACA CUGAUGAGGNNNNNNNNCCGAA ACCACCUU | 5080 |
| 5541 | UGGUAUGUA AUUUAUGC | 925 | GCAUAAAU CUGAUGAGGNNNNNNNNCCGAA ACAUACCA | 5081 |
| 5544 | UAUGUAAUU UAUGCAAG | 926 | CUUGCAUA CUGAUGAGGNNNNNNNNCCGAA AUUACAUA | 5082 |
| 5545 | AUGUAAUUU AUGCAAGG | 927 | CCUUGCAU CUGAUGAGGNNNNNNNNCCGAA AAUUACAU | 5083 |
| 5546 | UGUAAUUUA UGCAAGGU | 928 | ACCUUGCA CUGAUGAGGNNNNNNNNCCGAA AAAUUACA | 5084 |
| 5555 | UGCAAGGUA UUUCUCCA | 929 | UGGAGAAA CUGAUGAGGNNNNNNNNCCGAA ACCUUGCA | 5085 |
| 5557 | CAAGGUAUU UCUCCAGU | 930 | ACUGGAGA CUGAUGAGGNNNNNNNNCCGAA AUACCUUG | 5086 |
| 5558 | AAGGUAUUU CUCCAGUU | 931 | AACUGGAG CUGAUGAGGNNNNNNNNCCGAA AAUACCUU | 5087 |
| 5559 | AGGUAUUUC UCCAGUUG | 932 | CAACUGGA CUGAUGAGGNNNNNNNNCCGAA AAAUACCU | 5088 |
| 5561 | GUAUUUCUC CAGUUGGG | 933 | CCCAACUG CUGAUGAGGNNNNNNNNCCGAA AGAAAUAC | 5089 |
| 5566 | UCUCCAGUU GGGACUCA | 934 | UGAGUCCC CUGAUGAGGNNNNNNNNCCGAA ACUGGAGA | 5090 |
| 5573 | UUGGGACUC AGGAUAUU | 935 | AAUAUCCU CUGAUGAGGNNNNNNNNCCGAA AGUCCCAA | 5091 |
| 5579 | CUCAGGAUA UUAGUUAA | 936 | UUAACUAA CUGAUGAGGNNNNNNNNCCGAA AUCCUGAG | 5092 |
| 5581 | CAGGAUAUU AGUUAAUG | 937 | CAUUAACU CUGAUGAGGNNNNNNNNCCGAA AUAUCCUG | 5093 |
| 5582 | AGGAUAUUA GUUAAUGA | 938 | UCAUUAAC CUGAUGAGGNNNNNNNNCCGAA AAUAUCCU | 5094 |
| 5585 | AUAUUAGUU AAUGAGCC | 939 | GGCUCAUU CUGAUGAGGNNNNNNNNCCGAA ACUAAUAU | 5095 |
| 5586 | UAUUAGUUA AUGAGCCA | 940 | UGGCUCAU CUGAUGAGGNNNNNNNNCCGAA AACUAAUA | 5096 |
| 5596 | UGAGCCAUC ACUAGAAG | 941 | CUUCUAGU CUGAUGAGGNNNNNNNNCCGAA AUGGCUCA | 5097 |
| 5600 | CCAUCACUA GAAGAAAA | 942 | UUUUCUUC CUGAUGAGGNNNNNNNNCCGAA AGUGAUGG | 5098 |
| 5615 | AAGCCCAUU UCAACUG | 943 | CAGUUGAA CUGAUGAGGNNNNNNNNCCGAA AUGGGCUU | 5099 |
| 5616 | AGCCCAUUU CAACUGCU | 944 | GCAGUUGA CUGAUGAGGNNNNNNNNCCGAA AAUGGGCU | 5100 |
| 5617 | GCCCAUUUC AACUGCUU | 945 | AGCAGUUG CUGAUGAGGNNNNNNNNCCGAA AAAUGGGC | 5101 |
| 5618 | CCCAUUUUC AACUGCUU | 946 | AAGCAGUU CUGAUGAGGNNNNNNNNCCGAA AAAAUGGG | 5102 |
| 5626 | CAACUGCUU UGAAACUU | 947 | AAGUUUCA CUGAUGAGGNNNNNNNNCCGAA AGCAGUUG | 5103 |
| 5627 | AACUGCUUU GAAACUUG | 948 | CAAGUUUC CUGAUGAGGNNNNNNNNCCGAA AAGCAGUU | 5104 |
| 5634 | UUGAAACUU GCCUGGGG | 949 | CCCCAGGC CUGAUGAGGNNNNNNNNCCGAA AGUUUCAA | 5105 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5644 | CCUGGGGUC UGAGCAUG | 950 | CAUGCUCA CUGAUGAGGNNNNNNNNCCGAA ACCCCAGG | 5106 |
| 5661 | AUGGGAAUA GGGAGACA | 951 | UGUCUCCC CUGAUGAGGNNNNNNNNCCGAA AUUCCCAU | 5107 |
| 5674 | GACAGGGUA GGAAAGGG | 952 | CCCUUUCC CUGAUGAGGNNNNNNNNCCGAA ACCCUGUC | 5108 |
| 5688 | GGGCGCCUA CUCUUCAG | 953 | CUGAAGAG CUGAUGAGGNNNNNNNNCCGAA AGGCGCCC | 5109 |
| 5691 | CGCCUACUC UUCAGGGU | 954 | ACCCUGAA CUGAUGAGGNNNNNNNNCCGAA AGUAGGCG | 5110 |
| 5693 | CCUACUCUU CAGGGUCU | 955 | AGACCCUG CUGAUGAGGNNNNNNNNCCGAA AGAGUAGG | 5111 |
| 5694 | CUACUCUUC AGGGUCUA | 956 | UAGACCCU CUGAUGAGGNNNNNNNNCCGAA AAGAGUAG | 5112 |
| 5700 | UUCAGGGUC UAAAGAUC | 957 | GAUCUUUA CUGAUGAGGNNNNNNNNCCGAA ACCCUGAA | 5113 |
| 5702 | CAGGGUCUA AAGAUCAA | 958 | UUGAUCUU CUGAUGAGGNNNNNNNNCCGAA AGACCCUG | 5114 |
| 5708 | CUAAAGAUC AAGGGGGC | 959 | GCCCCUUG CUGAUGAGGNNNNNNNNCCGAA AUCUUUAG | 5115 |
| 5719 | GUGGGCCUU GGAUCGCU | 960 | AGCGAUCC CUGAUGAGGNNNNNNNNCCGAA AGGCCCAC | 5116 |
| 5724 | CCUUGGAUC GCUAAGCU | 961 | AGCUUAGC CUGAUGAGGNNNNNNNNCCGAA AUCCAAGG | 5117 |
| 5728 | GGAUCGCUA AGCUGGCU | 962 | AGCCAGCU CUGAUGAGGNNNNNNNNCCGAA AGCGAUCC | 5118 |
| 5737 | AGCUGGCUC UGUUUGAU | 963 | AUCAAACA CUGAUGAGGNNNNNNNNCCGAA AGCCAGCU | 5119 |
| 5741 | GGCUCUGUU UGAUGCUA | 964 | UAGCAUCA CUGAUGAGGNNNNNNNNCCGAA ACAGAGCC | 5120 |
| 5742 | GCUCUGUUU GAUGCUAU | 965 | AUAGCAUC CUGAUGAGGNNNNNNNNCCGAA AACAGAGC | 5121 |
| 5749 | UUGAUGCUA UUUAUGCA | 966 | UGCAUAAA CUGAUGAGGNNNNNNNNCCGAA AGCAUCAA | 5122 |
| 5751 | GAUGCUAUU UAUGCAAG | 967 | CUUGCAUA CUGAUGAGGNNNNNNNNCCGAA AUAGCAUC | 5123 |
| 5752 | AUGCUAUUU AUGCAAGU | 968 | ACUUGCAU CUGAUGAGGNNNNNNNNCCGAA AAUAGCAU | 5124 |
| 5753 | UGCUAUUUA UGCAAGUU | 969 | AACUUGCA CUGAUGAGGNNNNNNNNCCGAA AAAUAGCA | 5125 |
| 5761 | AUGCAAGUU AGGGUCUA | 970 | UAGACCCU CUGAUGAGGNNNNNNNNCCGAA ACUUGCAU | 5126 |
| 5762 | UGCAAGUUA GGGUCUAU | 971 | AUAGACCC CUGAUGAGGNNNNNNNNCCGAA AACUUGCA | 5127 |
| 5767 | GUUAGGGUC UAUGUAUU | 972 | AAUACAUA CUGAUGAGGNNNNNNNNCCGAA ACCCUAAC | 5128 |
| 5769 | UAGGGUCUA UGUAUUUA | 973 | UAAAUACA CUGAUGAGGNNNNNNNNCCGAA AGACCCUA | 5129 |
| 5773 | GUCUAUGUA UUUAGGAU | 974 | AUCCUAAA CUGAUGAGGNNNNNNNNCCGAA ACAUAGAC | 5130 |
| 5775 | CUAUGUAUU UAGGAUGC | 975 | GCAUCCUA CUGAUGAGGNNNNNNNNCCGAA AUACAUAG | 5131 |
| 5776 | UAUGUAUUU AGGAUGCG | 976 | CGCAUCCU CUGAUGAGGNNNNNNNNCCGAA AAAUACAUA | 5132 |
| 5777 | AUGUAUUUA GGAUGCGC | 977 | GCGCAUCC CUGAUGAGGNNNNNNNNCCGAA AAAUACAU | 5133 |
| 5788 | AUGCGCCUA CUCUUCAG | 978 | CUGAAGAG CUGAUGAGGNNNNNNNNCCGAA AGGCGCAU | 5134 |
| 5791 | CGCCUACUC UUCAGGGU | 954 | ACCCUGAA CUGAUGAGGNNNNNNNNCCGAA AGUAGGCG | 5110 |
| 5793 | CCUACUCUU CAGGGUCU | 955 | AGACCCUG CUGAUGAGGNNNNNNNNCCGAA AGAGUAGG | 5111 |
| 5794 | CUACUCUUC AGGGUCUA | 956 | UAGACCCU CUGAUGAGGNNNNNNNNCCGAA AAGAGUAG | 5112 |
| 5800 | UUCAGGGUC UAAAGAUC | 957 | GAUCUUUA CUGAUGAGGNNNNNNNNCCGAA ACCCUGAA | 5113 |
| 5802 | CAGGGUCUA AAGAUCAA | 958 | UUGAUCUU CUGAUGAGGNNNNNNNNCCGAA AGACCCUG | 5114 |
| 5808 | CUAAAGAUC AAGGGGGC | 959 | GCCCCUUG CUGAUGAGGNNNNNNNNCCGAA AUCUUUAG | 5115 |
| 5819 | GUGGGCCUU GGAUCGCU | 960 | AGCGAUCC CUGAUGAGGNNNNNNNNCCGAA AGGCCCAC | 5116 |
| 5824 | CCUUGGAUC GCUAAGCU | 961 | AGCUUAGC CUGAUGAGGNNNNNNNNCCGAA AUCCAAGG | 5117 |
| 5828 | GGAUCGCUA AGCUGGCU | 962 | AGCCAGCU CUGAUGAGGNNNNNNNNCCGAA AGCGAUCC | 5118 |
| 5837 | AGCUGGCUC UGUUUGAU | 963 | AUCAAACA CUGAUGAGGNNNNNNNNCCGAA AGCCAGCU | 5119 |
| 5841 | GGCUCUGUU UGAUGCUA | 964 | UAGCAUCA CUGAUGAGGNNNNNNNNCCGAA ACAGAGCC | 5120 |
| 5842 | GCUCUGUUU GAUGCUAU | 965 | AUAGCAUC CUGAUGAGGNNNNNNNNCCGAA AACAGAGC | 5121 |
| 5849 | UUGAUGCUA UUUAUGCA | 966 | UGCAUAAA CUGAUGAGGNNNNNNNNCCGAA AGCAUCAA | 5122 |
| 5851 | GAUGCUAUU UAUGCAAG | 967 | CUUGCAUA CUGAUGAGGNNNNNNNNCCGAA AUAGCAUC | 5123 |
| 5852 | AUGCUAUUU AUGCAAGU | 968 | ACUUGCAU CUGAUGAGGNNNNNNNNCCGAA AAUAGCAU | 5124 |
| 5853 | UGCUAUUUA UGCAAGUU | 969 | AACUUGCA CUGAUGAGGNNNNNNNNCCGAA AAAUAGCA | 5125 |
| 5861 | AUGCAAGUU AGGGUCUA | 970 | UAGACCCU CUGAUGAGGNNNNNNNNCCGAA ACUUGCAU | 5126 |
| 5862 | UGCAAGUUA GGGUCUAU | 971 | AUAGACCC CUGAUGAGGNNNNNNNNCCGAA AACUUGCA | 5127 |
| 5867 | GUUAGGGUC UAUGUAUU | 972 | AAUACAUA CUGAUGAGGNNNNNNNNCCGAA ACCCUAAC | 5128 |
| 5869 | UAGGGUCUA UGUAUUUA | 973 | UAAAUACA CUGAUGAGGNNNNNNNNCCGAA AGACCCUA | 5129 |
| 5873 | GUCUAUGUA UUUAGGAU | 974 | AUCCUAAA CUGAUGAGGNNNNNNNNCCGAA ACAUAGAC | 5130 |
| 5875 | CUAUGUAUU UAGGAUGU | 979 | ACAUCCUA CUGAUGAGGNNNNNNNNCCGAA AUACAUAG | 5135 |
| 5876 | UAUGUAUUU AGGAUGUC | 980 | GACAUCCU CUGAUGAGGNNNNNNNNCCGAA AAAUACAUA | 5136 |
| 5877 | AUGUAUUUA GGAUGUCU | 981 | AGACAUCC CUGAUGAGGNNNNNNNNCCGAA AAAUACAU | 5137 |
| 5884 | UAGGAUGUC UGCACCUU | 982 | AAGGUGCA CUGAUGAGGNNNNNNNNCCGAA ACAUCCUA | 5138 |
| 5892 | CUGCACCUU CUGCAGCC | 983 | GGCUGCAG CUGAUGAGGNNNNNNNNCCGAA AGGUGCAG | 5139 |
| 5893 | UGCACCUUC UGCAGCCA | 984 | UGGCUGCA CUGAUGAGGNNNNNNNNCCGAA AAGGUGCA | 5140 |
| 5904 | CAGCCAGUC AGAAGCUG | 985 | CAGCUUCU CUGAUGAGGNNNNNNNNCCGAA ACUGGCUG | 5141 |
| 5930 | CAGUGGAUU GCUGCUUC | 986 | GAAGCAGC CUGAUGAGGNNNNNNNNCCGAA AUCCACUG | 5142 |
| 5937 | UUGCUGCUU CUUGGGGA | 987 | UCCCCAAG CUGAUGAGGNNNNNNNNCCGAA AGCAGCAA | 5143 |
| 5938 | UGCUGCUUC UUGGGGAG | 988 | CUCCCCAA CUGAUGAGGNNNNNNNNCCGAA AAGCAGCA | 5144 |
| 5940 | CUGCUUCUU GGGGAGAA | 989 | UUCUCCCC CUGAUGAGGNNNNNNNNCCGAA AGAAGCAG | 5145 |
| 5953 | AGAAGAGUA UGCUUCCU | 990 | AGGAAGCA CUGAUGAGGNNNNNNNNCCGAA ACUCUUCU | 5146 |
| 5958 | AGUAUGCUU CCUUUUAU | 991 | AUAAAAGG CUGAUGAGGNNNNNNNNCCGAA AGCAUACU | 5147 |
| 5959 | GUAUGCUUC CUUUUAUC | 992 | GAUAAAAG CUGAUGAGGNNNNNNNNCCGAA AAGCAUAC | 5148 |
| 5962 | UGCUUCCUU UUAUCCAU | 993 | AUGGAUAA CUGAUGAGGNNNNNNNNCCGAA AGGAAGCA | 5149 |
| 5963 | GCUUCCUUU UAUCCAUG | 994 | CAUGGAUA CUGAUGAGGNNNNNNNNCCGAA AAGGAAGC | 5150 |
| 5964 | CUUCCUUUU AUCCAUGU | 995 | ACAUGGAU CUGAUGAGGNNNNNNNNCCGAA AAAGGAAG | 5151 |
| 5965 | UUCCUUUUA UCCAUGUA | 996 | UACAUGGA CUGAUGAGGNNNNNNNNCCGAA AAAAGGAAG | 5152 |
| 5967 | CCUUUUAUC CAUGUAAU | 997 | AUUACAUG CUGAUGAGGNNNNNNNNCCGAA AUAAAAGG | 5153 |
| 5973 | AUCCAUGUA AUUUAACU | 998 | AGUUAAAU CUGAUGAGGNNNNNNNNCCGAA ACAUGGAU | 5154 |
| 5976 | CAUGUAAUU UAACUGUA | 999 | UACAGUUA CUGAUGAGGNNNNNNNNCCGAA AUUACAUG | 5155 |
| 5977 | AUGUAAUUU AACUGUAG | 1000 | CUACAGUU CUGAUGAGGNNNNNNNNCCGAA AAUUACAU | 5156 |
| 5978 | UGUAAUUUA ACUGUAGA | 1001 | UCUACAGU CUGAUGAGGNNNNNNNNCCGAA AAAUUACA | 5157 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 5984 | UUAACUGUA GAACCUGA | 1002 | UCAGGUUC CUGAUGAGGNNNNNNNNCCGAA ACAGUUAA | 5158 |
| 5996 | CCUGAGCUC UAAGUAAC | 1003 | GUUACUUA CUGAUGAGGNNNNNNNNCCGAA AGCUCAGG | 5159 |
| 5998 | UGAGCUCUA AGUAACCG | 1004 | CGGUUACU CUGAUGAGGNNNNNNNNCCGAA AGAGCUCA | 5160 |
| 6002 | CUCUAAGUA ACCGAAGA | 1005 | UCUUCGGU CUGAUGAGGNNNNNNNNCCGAA ACUUAGAG | 5161 |
| 6015 | AAGAAUGUA UGCCUCUG | 1006 | CAGAGGCA CUGAUGAGGNNNNNNNNCCGAA ACAUUCUU | 5162 |
| 6021 | GUAUGCCUC UGUUCUUA | 1007 | UAAGAACA CUGAUGAGGNNNNNNNNCCGAA AGGCAUAC | 5163 |
| 6025 | GCCUCUGUU CUUAUGUG | 1008 | CACAUAAG CUGAUGAGGNNNNNNNNCCGAA ACAGAGGC | 5164 |
| 6026 | CCUCUGUUC UUAUGUGC | 1009 | GCACAUAA CUGAUGAGGNNNNNNNNCCGAA AACAGAGG | 5165 |
| 6028 | UCUGUUCUU AUGUGCCA | 1010 | UGGCACAU CUGAUGAGGNNNNNNNNCCGAA AGAACAGA | 5166 |
| 6029 | CUGUUCUUA UGUGCCAC | 1011 | GUGGCACA CUGAUGAGGNNNNNNNNCCGAA AAGAACAG | 5167 |
| 6040 | UGCCACAUC CUUGUUUA | 1012 | UAAACAAG CUGAUGAGGNNNNNNNNCCGAA AUGUGGCA | 5168 |
| 6043 | CACAUCCUU GUUUAAAG | 1013 | CUUUAAAC CUGAUGAGGNNNNNNNNCCGAA AGGAUGUG | 5169 |
| 6046 | AUCCUUGUU UAAAGGCU | 1014 | AGCCUUUA CUGAUGAGGNNNNNNNNCCGAA ACAAGGAU | 5170 |
| 6047 | UCCUUGUUU AAAGGCUC | 1015 | GAGCCUUU CUGAUGAGGNNNNNNNNCCGAA AACAAGGA | 5171 |
| 6048 | CCUUGUUUA AAGGCUCU | 1016 | AGAGCCUU CUGAUGAGGNNNNNNNNCCGAA AAACAAGG | 5172 |
| 6055 | UAAAGGCUC UCUGUAUG | 1017 | CAUACAGA CUGAUGAGGNNNNNNNNCCGAA AGCCUUUA | 5173 |
| 6057 | AAGGCUCUC UGUAUGAA | 1018 | UUCAUACA CUGAUGAGGNNNNNNNNCCGAA AGAGCCUU | 5174 |
| 6061 | CUCUCUGUA UGAAGAGA | 1019 | UCUCUUCA CUGAUGAGGNNNNNNNNCCGAA ACAGAGAG | 5175 |
| 6079 | GGGACCGUC AUCAGCAC | 1020 | GUGCUGAU CUGAUGAGGNNNNNNNNCCGAA ACGGUCCC | 5176 |
| 6082 | ACCGUCAUC AGCACAUU | 1021 | AAUGUGCU CUGAUGAGGNNNNNNNNCCGAA AUGACGGU | 5177 |
| 6090 | CAGCACAUU CCCUAGUG | 1022 | CACUAGGG CUGAUGAGGNNNNNNNNCCGAA AUGUGCUG | 5178 |
| 6091 | AGCACAUUC CCUAGUGA | 1023 | UCACUAGG CUGAUGAGGNNNNNNNNCCGAA AAUGUGCU | 5179 |
| 6095 | CAUUCCCUA GUGAGCCU | 1024 | AGGCUCAC CUGAUGAGGNNNNNNNNCCGAA AGGGAAUG | 5180 |
| 6104 | GUGAGCCUA CUGGCUCC | 1025 | GGAGCCAG CUGAUGAGGNNNNNNNNCCGAA AGGCUCAC | 5181 |
| 6111 | UACUGGCUC CUGGCAGC | 1026 | GCUGCCAG CUGAUGAGGNNNNNNNNCCGAA AGCCAGUA | 5182 |
| 6124 | CAGCGGCUU UUGUGGAA | 1027 | UUCCACAA CUGAUGAGGNNNNNNNNCCGAA AGCCGCUG | 5183 |
| 6125 | AGCGGCUUU UGUGGAAG | 1028 | CUUCCACA CUGAUGAGGNNNNNNNNCCGAA AAGCCGCU | 5184 |
| 6126 | GCGGCUUUU GUGGAAGA | 1029 | UCUUCCAC CUGAUGAGGNNNNNNNNCCGAA AAAGCCGC | 5185 |
| 6137 | GGAAGACUC ACUAGCCA | 1030 | UGGCUAGU CUGAUGAGGNNNNNNNNCCGAA AGUCUUCC | 5186 |
| 6141 | GACUCACUA GCCAGAAG | 1031 | CUUCUGGC CUGAUGAGGNNNNNNNNCCGAA AGUGAGUC | 5187 |
| 6166 | GGGACAGUC CUCUCCAC | 1032 | GUGGAGAG CUGAUGAGGNNNNNNNNCCGAA ACUGUCCC | 5188 |
| 6169 | ACAGUCCUC UCCACCAA | 1033 | UUGGUGGA CUGAUGAGGNNNNNNNNCCGAA AGGACUGU | 5189 |
| 6171 | AGUCCUCUC CACCAAGA | 1034 | UCUUGGUG CUGAUGAGGNNNNNNNNCCGAA AGAGGACU | 5190 |
| 6181 | ACCAAGAUC UAAAUCCA | 1035 | UGGAUUUA CUGAUGAGGNNNNNNNNCCGAA AUCUUGGU | 5191 |
| 6183 | CAAGAUCUA AAUCCAAA | 1036 | UUUGGAUU CUGAUGAGGNNNNNNNNCCGAA AGAUCUUG | 5192 |
| 6187 | AUCUAAAUC CAAACAAA | 1037 | UUUGUUUG CUGAUGAGGNNNNNNNNCCGAA AUUUAGAU | 5193 |
| 6204 | AGCAGGCUA GAGCCAGA | 1038 | UCUGGCUC CUGAUGAGGNNNNNNNNCCGAA AGCCUGCU | 5194 |
| 6226 | GGACAAAUC UUUGUUGU | 1039 | ACAACAAA CUGAUGAGGNNNNNNNNCCGAA AUUUGUCC | 5195 |
| 6228 | ACAAAUCUU UGUUGUUC | 1040 | GAACAACA CUGAUGAGGNNNNNNNNCCGAA AGAUUUGU | 5196 |
| 6229 | CAAAUCUUU GUUGUUCC | 1041 | GGAACAAC CUGAUGAGGNNNNNNNNCCGAA AAGAUUUG | 5197 |
| 6232 | AUCUUUGUU GUUCCUCU | 1042 | AGAGGAAC CUGAUGAGGNNNNNNNNCCGAA ACAAAGAU | 5198 |
| 6235 | UUUGUUGUU CCUCUUCU | 1043 | AGAAGAGG CUGAUGAGGNNNNNNNNCCGAA ACAACAAA | 5199 |
| 6236 | UUGUUGUUC CUCUUCUU | 1044 | AAGAAGAG CUGAUGAGGNNNNNNNNCCGAA AACAACAA | 5200 |
| 6239 | UUGUUCCUC UUCUUUAC | 1045 | GUAAAGAA CUGAUGAGGNNNNNNNNCCGAA AGGAACAA | 5201 |
| 6241 | GUUCCUCUU CUUUACAC | 1046 | GUGUAAAG CUGAUGAGGNNNNNNNNCCGAA AGAGGAAC | 5202 |
| 6242 | UUCCUCUUC UUUACACA | 1047 | UGUGUAAA CUGAUGAGGNNNNNNNNCCGAA AAGAGGAA | 5203 |
| 6244 | CCUCUUCUU UACACAUA | 1048 | UAUGUGUA CUGAUGAGGNNNNNNNNCCGAA AGAAGAGG | 5204 |
| 6245 | CUCUUCUUU ACACAUAC | 1049 | GUAUGUGU CUGAUGAGGNNNNNNNNCCGAA AAGAAGAG | 5205 |
| 6246 | UCUUCUUUA CACAUACG | 1050 | CGUAUGUG CUGAUGAGGNNNNNNNNCCGAA AAAGAAGA | 5206 |
| 6252 | UUACACAUA CGCAAACC | 1051 | GGUUUGCG CUGAUGAGGNNNNNNNNCCGAA AUGUGUAA | 5207 |
| 6280 | CUGGCAAUU UUAUAAAU | 1052 | AUUUAUAA CUGAUGAGGNNNNNNNNCCGAA AUUGCCAG | 5208 |
| 6281 | UGGCAAUUU UAUAAAUC | 1053 | GAUUUAUA CUGAUGAGGNNNNNNNNCCGAA AAUUGCCA | 5209 |
| 6282 | GGCAAUUUU AUAAAUCA | 1054 | UGAUUUAU CUGAUGAGGNNNNNNNNCCGAA AAAUUGCC | 5210 |
| 6283 | GCAAUUUUA UAAAUCAG | 1055 | CUGAUUUA CUGAUGAGGNNNNNNNNCCGAA AAAAUUGC | 5211 |
| 6285 | AAUUUUAUA AAUCAGGU | 1056 | ACCUGAUU CUGAUGAGGNNNNNNNNCCGAA AUAAAAUU | 5212 |
| 6289 | UUAUAAAUC AGGUAACU | 1057 | AGUUACCU CUGAUGAGGNNNNNNNNCCGAA AUUUAUAA | 5213 |
| 6294 | AAUCAGGUA ACUGGAAG | 1058 | CUUCCAGU CUGAUGAGGNNNNNNNNCCGAA ACCUGAUU | 5214 |
| 6308 | AAGGAGGUU AAACUCAG | 1059 | CUGAGUUU CUGAUGAGGNNNNNNNNCCGAA ACCUCCUU | 5215 |
| 6309 | AGGAGGUUA AACUCAGA | 1060 | UCUGAGUU CUGAUGAGGNNNNNNNNCCGAA AACCUCCU | 5216 |
| 6314 | GUUAAACUC AGAAAAAA | 1061 | UUUUUUCU CUGAUGAGGNNNNNNNNCCGAA AGUUUAAC | 5217 |
| 6331 | GAAGACCUC AGUCAAUU | 1062 | AAUUGACU CUGAUGAGGNNNNNNNNCCGAA AGGUCUUC | 5218 |
| 6335 | ACCUCAGUC AAUUCUCU | 1063 | AGAGAAUU CUGAUGAGGNNNNNNNNCCGAA ACUGAGGU | 5219 |
| 6339 | CAGUCAAUU CUCUACUU | 1064 | AAGUAGAG CUGAUGAGGNNNNNNNNCCGAA AUUGACUG | 5220 |
| 6340 | AGUCAAUUC UCUACUUU | 1065 | AAAGUAGA CUGAUGAGGNNNNNNNNCCGAA AAUUGACU | 5221 |
| 6342 | UCAAUUCUC UACUUUUU | 1066 | AAAAAGUA CUGAUGAGGNNNNNNNNCCGAA AGAAUUGA | 5222 |
| 6344 | AAUUCUCUA CUUUUUUU | 1067 | AAAAAAAG CUGAUGAGGNNNNNNNNCCGAA AGAGAAUU | 5223 |
| 6347 | UCUCUACUU UUUUUUUU | 1068 | AAAAAAAA CUGAUGAGGNNNNNNNNCCGAA AGUAGAGA | 5224 |
| 6348 | CUCUACUUU UUUUUUUU | 1069 | AAAAAAAA CUGAUGAGGNNNNNNNNCCGAA AAGUAGAG | 5225 |
| 6349 | UCUACUUUU UUUUUUUU | 1070 | AAAAAAAA CUGAUGAGGNNNNNNNNCCGAA AAAGUAGA | 5226 |
| 6350 | CUACUUUUU UUUUUUUU | 1071 | AAAAAAAA CUGAUGAGGNNNNNNNNCCGAA AAAAGUAG | 5227 |
| 6351 | UACUUUUUU UUUUUUUU | 1072 | AAAAAAAA CUGAUGAGGNNNNNNNNCCGAA AAAAAGUA | 5228 |
| 6352 | ACUUUUUUU UUUUUUUU | 1073 | AAAAAAAA CUGAUGAGGNNNNNNNNCCGAA AAAAAAGU | 5229 |
| 6353 | CUUUUUUUU UUUUUUUU | 1074 | AAAAAAAA CUGAUGAGGNNNNNNNNCCGAA AAAAAAAG | 5230 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6354 | UUUUUUUUU UUUUUUUC | 1075 | GAAAAAAA CUGAUGAGgnnnnnnnnCCGAA AAAAAAAA | 5231 |
| 6355 | UUUUUUUUU UUUUUUCC | 1076 | GGAAAAAA CUGAUGAGgnnnnnnnnCCGAA AAAAAAAA | 5232 |
| 6356 | UUUUUUUUU UUUUUCCA | 1077 | UGGAAAAA CUGAUGAGgnnnnnnnnCCGAA AAAAAAAA | 5233 |
| 6357 | UUUUUUUUU UUUUCCAA | 1078 | UUGGAAAA CUGAUGAGgnnnnnnnnCCGAA AAAAAAAA | 5234 |
| 6358 | UUUUUUUUU UUUCCAAA | 1079 | UUUGGAAA CUGAUGAGgnnnnnnnnCCGAA AAAAAAAA | 5235 |
| 6359 | UUUUUUUUU UUCCAAAU | 1080 | AUUUGGAA CUGAUGAGgnnnnnnnnCCGAA AAAAAAAA | 5236 |
| 6360 | UUUUUUUUU UCCAAAUC | 1081 | GAUUUGGA CUGAUGAGgnnnnnnnnCCGAA AAAAAAAA | 5237 |
| 6361 | UUUUUUUUU CCAAAUCA | 1082 | UGAUUUGG CUGAUGAGgnnnnnnnnCCGAA AAAAAAAA | 5238 |
| 6362 | UUUUUUUUC CAAAUCAG | 1083 | CUGAUUUG CUGAUGAGgnnnnnnnnCCGAA AAAAAAAA | 5239 |
| 6368 | UUCCAAAUC AGAUAAUA | 1084 | UAUUAUCU CUGAUGAGgnnnnnnnnCCGAA AUUUGGAA | 5240 |
| 6373 | AAUCAGAUA AUAGCCCA | 1085 | UGGGCUAU CUGAUGAGgnnnnnnnnCCGAA AUCUGAUU | 5241 |
| 6376 | CAGAUAAUA GCCCAGCA | 1086 | UGCUGGGC CUGAUGAGgnnnnnnnnCCGAA AUUAUCUG | 5242 |
| 6388 | CAGCAAAUA GUGAUAAC | 1087 | GUUAUCAC CUGAUGAGgnnnnnnnnCCGAA AUUUGCUG | 5243 |
| 6394 | AUAGUGAUA ACAAAUAA | 1088 | UUAUUUGU CUGAUGAGgnnnnnnnnCCGAA AUCACUAU | 5244 |
| 6401 | UAACAAAUA AAACCUUA | 1089 | UAAGGUUU CUGAUGAGgnnnnnnnnCCGAA AUUUGUUA | 5245 |
| 6408 | UAAAACCUU AGCUGUUC | 1090 | GAACAGCU CUGAUGAGgnnnnnnnnCCGAA AGGUUUUA | 5246 |
| 6409 | AAAACCUUA GCUGUUCA | 1091 | UGAACAGC CUGAUGAGgnnnnnnnnCCGAA AAGGUUUU | 5247 |
| 6415 | UUAGCUGUU CAUGCUAU | 1092 | AAGACAUG CUGAUGAGgnnnnnnnnCCGAA ACAGCUAA | 5248 |
| 6416 | UAGCUGUUC AUGUCUUG | 1093 | CAAGACAU CUGAUGAGgnnnnnnnnCCGAA AACAGCUA | 5249 |
| 6421 | GUUCAUGUC UUGAUUUC | 1094 | GAAAUCAA CUGAUGAGgnnnnnnnnCCGAA ACAUGAAC | 5250 |
| 6423 | UCAUGUCUU GAUUUCAA | 1095 | UUGAAAUC CUGAUGAGgnnnnnnnnCCGAA AGACAUGA | 5251 |
| 6427 | GUCUUGAUU UCAAUAAU | 1096 | AUUAUUGA CUGAUGAGgnnnnnnnnCCGAA AUCAAGAC | 5252 |
| 6428 | UCUUGAUUU CAAUAAUU | 1097 | AAUUAUUG CUGAUGAGgnnnnnnnnCCGAA AAUCAAGA | 5253 |
| 6429 | CUUGAUUUC AAUAAUUA | 1098 | UAAUUAUU CUGAUGAGgnnnnnnnnCCGAA AAAUCAAG | 5254 |
| 6433 | AUUUCAAUA AUUAAUUC | 1099 | GAAUUAAU CUGAUGAGgnnnnnnnnCCGAA AUUGAAAU | 5255 |
| 6436 | UCAAUAAUU AAUUCUUA | 1100 | UAAGAAUU CUGAUGAGgnnnnnnnnCCGAA AUUAUUGA | 5256 |
| 6437 | CAAUAAUUA AUUCUUAA | 1101 | UUAAGAAU CUGAUGAGgnnnnnnnnCCGAA AAUUAUUG | 5257 |
| 6440 | UAAUUAAUU CUUAAUCA | 1102 | UGAUUAAG CUGAUGAGgnnnnnnnnCCGAA AUUAAUUA | 5258 |
| 6441 | AAUUAAUUC UUAAUCAU | 1103 | AUGAUUAA CUGAUGAGgnnnnnnnnCCGAA AAUUAAUU | 5259 |
| 6443 | UUAAUUCUU AAUCAUUA | 1104 | UAAUGAUU CUGAUGAGgnnnnnnnnCCGAA AGAAUUAA | 5260 |
| 6444 | UAAUUCUUA AUCAUUAA | 1105 | UUAAUGAU CUGAUGAGgnnnnnnnnCCGAA AAGAAUUA | 5261 |
| 6447 | UUCUUAAUC AUUAAGAG | 1106 | CUCUUAAU CUGAUGAGgnnnnnnnnCCGAA AUUAAGAA | 5262 |
| 6450 | UUAAUCAUU AAGAGACC | 1107 | GGUCUCUU CUGAUGAGgnnnnnnnnCCGAA AUGAUUAA | 5263 |
| 6451 | UAAUCAUUA AGAGACCA | 1108 | UGGUCUCU CUGAUGAGgnnnnnnnnCCGAA AAUGAUUA | 5264 |
| 6461 | GAGACCAUA AUACUCCC | 1109 | GUAUUUAC CUGAUGAGgnnnnnnnnCCGAA AUGGUCUC | 5265 |
| 6464 | ACCAUAAUA AAUACUCC | 1110 | GGAGUAUU CUGAUGAGgnnnnnnnnCCGAA AUUAUGGU | 5266 |
| 6468 | UAAUAAAUA CUCCUUUU | 1111 | AAAAGGAG CUGAUGAGgnnnnnnnnCCGAA AUUUAUUA | 5267 |
| 6471 | UAAAUACUC CUUUUCAA | 1112 | UUGAAAAG CUGAUGAGgnnnnnnnnCCGAA AGUAUUUA | 5268 |
| 6474 | AUACUCCUU UCAAGAGA | 1113 | CUCUUGAA CUGAUGAGgnnnnnnnnCCGAA AGGAGUAU | 5269 |
| 6475 | UACUCCUUU CAAGAGAA | 1114 | UCUCUUGA CUGAUGAGgnnnnnnnnCCGAA AAGGAGUA | 5270 |
| 6476 | ACUCCUUUC AAGAGAAA | 1115 | UUCUCUUG CUGAUGAGgnnnnnnnnCCGAA AAAGGAGU | 5271 |
| 6477 | CUCCUUUUC AAGAGAAA | 1116 | UUUCUCUU CUGAUGAGgnnnnnnnnCCGAA AAAAGGAG | 5272 |
| 6497 | AAAACCAUU GAAUUGU | 1117 | ACAAUUCU CUGAUGAGgnnnnnnnnCCGAA AUGGUUUU | 5273 |
| 6498 | AAACCAUUA GAAUUGUU | 1118 | AACAAUUC CUGAUGAGgnnnnnnnnCCGAA AAUGGUUU | 5274 |
| 6503 | AUUAGAAUU GUUACUCA | 1119 | UGAGUAAC CUGAUGAGgnnnnnnnnCCGAA AUUCUAAU | 5275 |
| 6506 | AGAAUUGUU ACUCAGCU | 1120 | AGCUGAGU CUGAUGAGgnnnnnnnnCCGAA ACAAUUCU | 5276 |
| 6507 | GAAUUGUUA CUCAGCUC | 1121 | GAGCUGAG CUGAUGAGgnnnnnnnnCCGAA AACAAUUC | 5277 |
| 6510 | UUGUUACUC AGCUCCUU | 1122 | AAGGAGCU CUGAUGAGgnnnnnnnnCCGAA AGUAACAA | 5278 |
| 6515 | ACUCAGCUC CUUCAAAC | 1123 | GUUUGAAG CUGAUGAGgnnnnnnnnCCGAA AGCUGAGU | 5279 |
| 6518 | CAGCUCCUU CAAACUCA | 1124 | UGAGUUUG CUGAUGAGgnnnnnnnnCCGAA AGGAGCUG | 5280 |
| 6519 | AGCUCCUUC AAACUCAG | 1125 | CUGAGUUU CUGAUGAGgnnnnnnnnCCGAA AAGGAGCU | 5281 |
| 6525 | UUCAAACUC AGGUUGU | 1126 | ACAAACCU CUGAUGAGgnnnnnnnnCCGAA AGUUUGAA | 5282 |
| 6530 | ACUCAGGUU UGUAGCAU | 1127 | AUGCUACA CUGAUGAGgnnnnnnnnCCGAA ACCUGAGU | 5283 |
| 6531 | CUCAGGUUU GUAGCAUA | 1128 | UAUGCUAC CUGAUGAGgnnnnnnnnCCGAA AACCUGAG | 5284 |
| 6534 | AGGUUUGUA GCAUACAU | 1129 | AUGUAUGC CUGAUGAGgnnnnnnnnCCGAA ACAAACCU | 5285 |
| 6539 | UGUAGCAUA CAUGAGUC | 1130 | GACUCAUG CUGAUGAGgnnnnnnnnCCGAA AUGCUACA | 5286 |
| 6547 | ACAUGAGUC CAUCCAUC | 1131 | GAUGGAUG CUGAUGAGgnnnnnnnnCCGAA ACUCAUGU | 5287 |
| 6551 | GAGUCCAUC CAUCAGUC | 1132 | GACUGAUG CUGAUGAGgnnnnnnnnCCGAA AUGGACUC | 5288 |
| 6555 | CCAUCCAUC AGUCAAAG | 1133 | CUUUGACU CUGAUGAGgnnnnnnnnCCGAA AUGGAUGG | 5289 |
| 6559 | CCAUCAGUC AAAGAAUG | 1134 | CAUUCUUU CUGAUGAGgnnnnnnnnCCGAA ACUGAUGG | 5290 |
| 6570 | AGAAUGGUU CCAUCUGG | 1135 | CCAGAUGG CUGAUGAGgnnnnnnnnCCGAA ACCAUUCU | 5291 |
| 6571 | GAAUGGUUC CAUCUGGA | 1136 | UCCAGAUG CUGAUGAGgnnnnnnnnCCGAA AACCAUUC | 5292 |
| 6575 | GGUUCCAUC UGGAGUCU | 1137 | AGACUCCA CUGAUGAGgnnnnnnnnCCGAA AUGGAACC | 5293 |
| 6582 | UCUGGAGUC UUAAUGUA GA | 1138 | UACAUUAA CUGAUGAGgnnnnnnnnCCGAA ACUCCAGA | 5294 |
| 6584 | UGGAGUCUU AAUGUAGA | 1139 | UCUACAUU CUGAUGAGgnnnnnnnnCCGAA AGACUCCA | 5295 |
| 6585 | GCAGUCUUA AUGUAGAA | 1140 | UUCUACAU CUGAUGAGgnnnnnnnnCCGAA AAGACUCC | 5296 |
| 6590 | CUUAAUGUA GAAAGAAA | 1141 | UUUCUUUC CUGAUGAGgnnnnnnnnCCGAA ACAUUAAG | 5297 |
| 6609 | UGGAGACUU AUAAUAAU | 1142 | AUUAUUAC CUGAUGAGgnnnnnnnnCCGAA AGUCUCCA | 5298 |
| 6612 | AGACUUGUA AUAAUGAG | 1143 | CUCAUUAU CUGAUGAGgnnnnnnnnCCGAA ACAAGUCU | 5299 |
| 6615 | CUUGUAAUA AUGAGCUA | 1144 | UAGCUCAU CUGAUGAGgnnnnnnnnCCGAA AUUACAAG | 5300 |
| 6623 | AAUGAGCUA GUUACAAA | 1145 | UUUGUAAC CUGAUGAGgnnnnnnnnCCGAA AGCUCAUU | 5301 |
| 6626 | GAGCUAGUU ACAAAGUG | 1146 | CACUUUGU CUGAUGAGgnnnnnnnnCCGAA ACUAGCUC | 5302 |
| 6627 | AGCUAGUUA CAAAGUGC | 1147 | GCACUUUG CUGAUGAGgnnnnnnnnCCGAA AACUAGCU | 5303 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 6637 | AAAGUGCUU GUUCAUUA | 1148 | UAAUGAAC CUGAUGAGGNNNNNNNNCCGAA AGCACUUU | 5304 |
| 6640 | GUGCUUGUU CAUUAAAA | 1149 | UUUUAAUG CUGAUGAGGNNNNNNNNCCGAA ACAAGCAC | 5305 |
| 6641 | UGCUUGUUC AUUAAAAU | 1150 | AUUUUAAU CUGAUGAGGNNNNNNNNCCGAA AACAAGCA | 5306 |
| 6644 | UUGUUCAUU AAAAUAGC | 1151 | GCUAUUUU CUGAUGAGGNNNNNNNNCCGAA AUGAACAA | 5307 |
| 6645 | UGUUCAUUA AAAUAGCA | 1152 | UGCUAUUU CUGAUGAGGNNNNNNNNCCGAA AAUGAACA | 5308 |
| 6650 | AUUAAAAUA GCACUGAA | 1153 | UUCAGUGC CUGAUGAGGNNNNNNNNCCGAA AUUUUAAU | 5309 |
| 6662 | CUGAAAAUU GAAACAUG | 1154 | CAUGUUUC CUGAUGAGGNNNNNNNNCCGAA AUUUUCAG | 5310 |
| 6674 | ACAUGAAUU AACUGAUA | 1155 | UAUCAGUU CUGAUGAGGNNNNNNNNCCGAA AUUCAUGU | 5311 |
| 6675 | CAUGAAUUA ACUGAUAA | 1156 | UUAUCAGU CUGAUGAGGNNNNNNNNCCGAA AAUUCAUG | 5312 |
| 6682 | UAACUGAUA AUAUUCCA | 1157 | UGGAAUAU CUGAUGAGGNNNNNNNNCCGAA AUCAGUUA | 5313 |
| 6685 | CUGAUAAUA UUCCAAUC | 1158 | GAUUGGAA CUGAUGAGGNNNNNNNNCCGAA AUUAUCAG | 5314 |
| 6687 | GAUAAUAUU CCAAUCAU | 1159 | AUGAUUGG CUGAUGAGGNNNNNNNNCCGAA AUAUUAUC | 5315 |
| 6688 | AUAAUAUUC CAAUCAUU | 1160 | AAUGAUUG CUGAUGAGGNNNNNNNNCCGAA AAUAUUAU | 5316 |
| 6693 | AUUCCAAUC AUUGCCA | 1161 | UGGCAAAU CUGAUGAGGNNNNNNNNCCGAA AUUGGAAU | 5317 |
| 6696 | CCAAUCAUU GCCAUUU | 1162 | AAAUGGCA CUGAUGAGGNNNNNNNNCCGAA AUGAUUGG | 5318 |
| 6697 | CAAUCAUUU GCCAUUUA | 1163 | UAAAUGGC CUGAUGAGGNNNNNNNNCCGAA AAUGAUUG | 5319 |
| 6703 | UUUGCCAUU UAUGACAA | 1164 | UUGUCAUA CUGAUGAGGNNNNNNNNCCGAA AUGGCAAA | 5320 |
| 6704 | UUGCCAUUU AUGACAAA | 1165 | UUUGUCAU CUGAUGAGGNNNNNNNNCCGAA AAUGGCAA | 5321 |
| 6705 | UGCCAUUUA UGACAAAA | 1166 | UUUUGUCA CUGAUGAGGNNNNNNNNCCGAA AAAUGGCA | 5322 |
| 6719 | AAAAUGGUU GGCACUAA | 1167 | UUAGUGCC CUGAUGAGGNNNNNNNNCCGAA ACCAUUUU | 5323 |
| 6726 | UUGGCACUA ACAAAGAA | 1168 | UUCUUUGU CUGAUGAGGNNNNNNNNCCGAA AGUGCCAA | 5324 |
| 6743 | CGAGCACUU CCUUUCAG | 1169 | CUGAAAGG CUGAUGAGGNNNNNNNNCCGAA AGUGCUCG | 5325 |
| 6744 | GAGCACUUC CUUUCAGA | 1170 | UCUGAAAG CUGAUGAGGNNNNNNNNCCGAA AAGUGCUC | 5326 |
| 6747 | CACUUCCUU UCAGAGUU | 1171 | AACUCUGA CUGAUGAGGNNNNNNNNCCGAA AGGAAGUG | 5327 |
| 6748 | ACUUCCUUU CAGAGUUU | 1172 | AAACUCUG CUGAUGAGGNNNNNNNNCCGAA AAGGAAGU | 5328 |
| 6749 | CUUCCUUUC AGAGUUUC | 1173 | GAAACUCU CUGAUGAGGNNNNNNNNCCGAA AAAGGAAG | 5329 |
| 6755 | UUCAGAGUU CUGAGAU | 1174 | AUCUCAGA CUGAUGAGGNNNNNNNNCCGAA ACUCUGAA | 5330 |
| 6756 | UCAGAGUUU CUGAGAUA | 1175 | UAUCUCAG CUGAUGAGGNNNNNNNNCCGAA AACUCUGA | 5331 |
| 6757 | CAGAGUUUC UGAGAUAA | 1176 | UUAUCUCA CUGAUGAGGNNNNNNNNCCGAA AAACUCUG | 5332 |
| 6764 | UCUGAGAUA AUGUACGU | 1177 | ACGUACAU CUGAUGAGGNNNNNNNNCCGAA AUCUCAGA | 5333 |
| 6769 | GAUAAUGUA CGUAAAC | 1178 | GUUCCACG CUGAUGAGGNNNNNNNNCCGAA ACAUUAUC | 5334 |
| 6781 | GGAACAGUC UGGGUGGA | 1179 | UCCACCCA CUGAUGAGGNNNNNNNNCCGAA ACUGUUCC | 5335 |
| 6814 | GUGCAAGUC UGUGUCUU | 1180 | AAGACACA CUGAUGAGGNNNNNNNNCCGAA ACUUGCAC | 5336 |
| 6820 | GUCUGUGUC UUGUCAGU | 1181 | ACUGACAA CUGAUGAGGNNNNNNNNCCGAA ACACAGAC | 5337 |
| 6822 | CUGUGUCUU GUCAGUCC | 1182 | GGACUGAC CUGAUGAGGNNNNNNNNCCGAA AGACACAG | 5338 |
| 6825 | UGUCUUGUC AGUCCAAG | 1183 | CUUGGACU CUGAUGAGGNNNNNNNNCCGAA ACAAGACA | 5339 |
| 6829 | UUGUCAGUC CAAGAAGU | 1184 | ACUUCUUG CUGAUGAGGNNNNNNNNCCGAA ACUGACAA | 5340 |
| 6851 | CGAGAUGUU AAUUUUAG | 1185 | CUAAAAUU CUGAUGAGGNNNNNNNNCCGAA ACAUCUCG | 5341 |
| 6852 | GAGAUGUUA AUUUUAGG | 1186 | CCUAAAAU CUGAUGAGGNNNNNNNNCCGAA AACAUCUC | 5342 |
| 6855 | AUGUUAAUU UUAGGGAC | 1187 | GUCCCUAA CUGAUGAGGNNNNNNNNCCGAA AUUAACAU | 5343 |
| 6856 | UGUUAAUUU UAGGGACC | 1188 | GGUCCCUA CUGAUGAGGNNNNNNNNCCGAA AAUUAACA | 5344 |
| 6857 | GUUAAUUUU AGGGACCC | 1189 | GGGUCCCU CUGAUGAGGNNNNNNNNCCGAA AAAUUAAC | 5345 |
| 6858 | UUAAUUUUA GGGACCCG | 1190 | CGGGUCCC CUGAUGAGGNNNNNNNNCCGAA AAAAUUAA | 5346 |
| 6872 | CCGUGCCUU GUUUCCUA | 1191 | UAGGAAAC CUGAUGAGGNNNNNNNNCCGAA AGGCACGG | 5347 |
| 6875 | UGCCUUGUU UCCUAGCC | 1192 | GGCUAGGA CUGAUGAGGNNNNNNNNCCGAA ACAAGGCA | 5348 |
| 6876 | GCCUUGUUU CCUAGCCC | 1193 | GGGCUAGG CUGAUGAGGNNNNNNNNCCGAA AACAAGGC | 5349 |
| 6877 | CCUUGUUUC CUAGCCCA | 1194 | UGGGCUAG CUGAUGAGGNNNNNNNNCCGAA AAACAAGG | 5350 |
| 6880 | UGUUUCCUA GCCCACAA | 1195 | UUGUGGGC CUGAUGAGGNNNNNNNNCCGAA AGGAAACA | 5351 |
| 6901 | GCAAACAUC AAACAGAU | 1196 | AUCUGUUU CUGAUGAGGNNNNNNNNCCGAA AUGUUUGC | 5352 |
| 6910 | AAACAGAUA CUCGCUAG | 1197 | CUAGCGAG CUGAUGAGGNNNNNNNNCCGAA AUCUGUUU | 5353 |
| 6913 | CAGAUACUC GCUAGCCU | 1198 | AGGCUAGC CUGAUGAGGNNNNNNNNCCGAA AGUAUCUG | 5354 |
| 6917 | UACUCGCUA GCCUCAUU | 1199 | AAUGAGGC CUGAUGAGGNNNNNNNNCCGAA AGCGAGUA | 5355 |
| 6922 | GCUAGCCUC AUUUAAAU | 1200 | AUUUAAAU CUGAUGAGGNNNNNNNNCCGAA AGGCUAGC | 5356 |
| 6925 | AGCCUCAUU UAAAUUGA | 1201 | UCAAUUUA CUGAUGAGGNNNNNNNNCCGAA AUGAGGCU | 5357 |
| 6926 | GCCUCAUUU AAAUUGAU | 1202 | AUCAAUUU CUGAUGAGGNNNNNNNNCCGAA AAAUGAGGC | 5358 |
| 6927 | CCUCAUUUA AAUUGAUU | 1203 | AAUCAAUU CUGAUGAGGNNNNNNNNCCGAA AAAUGAGG | 5359 |
| 6931 | AUUUAAAUU GAUUAAAG | 1204 | CUUUAAUC CUGAUGAGGNNNNNNNNCCGAA AUUUAAAU | 5360 |
| 6935 | AAAUUGAUU AAGGAGG | 1205 | CCUCCUUU CUGAUGAGGNNNNNNNNCCGAA AUCAAUUU | 5361 |
| 6936 | AAUUGAUUA AAGGAGGA | 1206 | UCCUCCUU CUGAUGAGGNNNNNNNNCCGAA AAUCAAUU | 5362 |
| 6951 | GAGUGCAUC UUUGCCCG | 1207 | CGGGCAAA CUGAUGAGGNNNNNNNNCCGAA AUGCACUC | 5363 |
| 6953 | GUGCAUCUU UGGCCGAC | 1208 | GUCGGCCA CUGAUGAGGNNNNNNNNCCGAA AGAUGCAC | 5364 |
| 6954 | UGCAUCUUU GGCCGACA | 1209 | UGUCGGCC CUGAUGAGGNNNNNNNNCCGAA AAGAUGCA | 5365 |
| 6970 | AGUGGUGUA ACUGUGUG | 1210 | CACACAGU CUGAUGAGGNNNNNNNNCCGAA ACACCACU | 5366 |
| 7026 | GUGGGUGUA UGUGUGUU | 1211 | AACACACA CUGAUGAGGNNNNNNNNCCGAA ACACCCAC | 5367 |
| 7034 | AUGUGUGUU UUGUGCAU | 1212 | AUGCACAA CUGAUGAGGNNNNNNNNCCGAA ACACACAU | 5368 |
| 7035 | UGUGUGUUU UGUGCAUA | 1213 | UAUGCACA CUGAUGAGGNNNNNNNNCCGAA AACACACA | 5369 |
| 7036 | GUGUGUUUU GUGCAUAA | 1214 | UUAUGCAC CUGAUGAGGNNNNNNNNCCGAA AAACACAC | 5370 |
| 7043 | UUGUGCAUA ACUAUUUA | 1215 | UAAAUAGU CUGAUGAGGNNNNNNNNCCGAA AUGCACAA | 5371 |
| 7047 | GCAUAACUA UUUAAGGA | 1216 | UCCUUAAA CUGAUGAGGNNNNNNNNCCGAA AGUUAUGC | 5372 |
| 7049 | AUAACUAUU UAAGGAAA | 1217 | UUUCCUUA CUGAUGAGGNNNNNNNNCCGAA AUAGUUAU | 5373 |
| 7050 | UAACUAUUU AAGGAAAC | 1218 | GUUUCCUU CUGAUGAGGNNNNNNNNCCGAA AAUAGUUA | 5374 |
| 7051 | AACUAUUUA AGGAAACU | 1219 | AGUUUCCU CUGAUGAGGNNNNNNNNCCGAA AAAUAGUU | 5375 |
| 7065 | ACUGGAAUU UUAAAGUU | 1220 | AACUUUAA CUGAUGAGGNNNNNNNNCCGAA AUUCCAGU | 5376 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7066 | CUGGAAUUU UAAAGUUA | 1221 | UAACUUUA CUGAUGAGGNNNNNNNNCCGAA AAUUCCAG | 5377 |
| 7067 | UGGAAUUUU AAAGUUAC | 1222 | GUAACUUU CUGAUGAGGNNNNNNNNCCGAA AAAUUCCA | 5378 |
| 7068 | GGAAUUUUA AAGUUACU | 1223 | AGUAACUU CUGAUGAGGNNNNNNNNCCGAA AAAAUUCC | 5379 |
| 7073 | UUUAAAGUU ACUUUUAU | 1224 | AUAAAAGU CUGAUGAGGNNNNNNNNCCGAA ACUUUAAA | 5380 |
| 7074 | UUAAAGUUA CUUUUAUA | 1225 | UAUAAAAG CUGAUGAGGNNNNNNNNCCGAA AACUUUAA | 5381 |
| 7077 | AAGUUACUU UUAUACAA | 1226 | UUGUAUAA CUGAUGAGGNNNNNNNNCCGAA AGUAACUU | 5382 |
| 7078 | AGUUACUUU UAUACAAA | 1227 | UUUGUAUA CUGAUGAGGNNNNNNNNCCGAA AAGUAACU | 5383 |
| 7079 | GUUACUUUU AUACAAAC | 1228 | GUUUGUAU CUGAUGAGGNNNNNNNNCCGAA AAAGUAAC | 5384 |
| 7080 | UUACUUUUA UACAAACC | 1229 | GGUUUGUA CUGAUGAGGNNNNNNNNCCGAA AAAAGUAA | 5385 |
| 7082 | ACUUUUAUA CAAACCAA | 1230 | UUGGUUUG CUGAUGAGGNNNNNNNNCCGAA AUAAAAGU | 5386 |
| 7095 | CCAAGAAUA UAUGCUAC | 1231 | GUAGCAUA CUGAUGAGGNNNNNNNNCCGAA AUUCUUGG | 5387 |
| 7097 | AAGAAUAUA UGCUACAG | 1232 | CUGUAGCA CUGAUGAGGNNNNNNNNCCGAA AUAUUCUU | 5388 |
| 7102 | UAUAUGCUA CAGAUAUA | 1233 | UAUAUCUG CUGAUGAGGNNNNNNNNCCGAA AGCAUAUA | 5389 |
| 7108 | CUACAGAUA UAGACAG | 1234 | CUGUCUUA CUGAUGAGGNNNNNNNNCCGAA AUCUGUAG | 5390 |
| 7110 | ACAGAUAUA AGACAGAC | 1235 | GUCUGUCU CUGAUGAGGNNNNNNNNCCGAA AUAUCUGU | 5391 |
| 7124 | GACAUGGUU UGGUCCUA | 1236 | UAGGACCA CUGAUGAGGNNNNNNNNCCGAA ACCAUGUC | 5392 |
| 7125 | ACAUGGUUU GGUCCUAU | 1237 | AUAGGACC CUGAUGAGGNNNNNNNNCCGAA AACCAUGU | 5393 |
| 7129 | GGUUUGGUC CUAUAUUU | 1238 | AAAUAUAG CUGAUGAGGNNNNNNNNCCGAA ACCAAACC | 5394 |
| 7132 | UUGGUCCUA UAUUUCUA | 1239 | UAGAAAUA CUGAUGAGGNNNNNNNNCCGAA AGGACCAA | 5395 |
| 7134 | GGUCCUAUA UUUCUAGU | 1240 | ACUAGAAA CUGAUGAGGNNNNNNNNCCGAA AUAGGACC | 5396 |
| 7136 | UCCUAUAUU UCUAGUCA | 1241 | UGACUAGA CUGAUGAGGNNNNNNNNCCGAA AUAUAGGA | 5397 |
| 7137 | CCUAUAUUU CUAGUCAU | 1242 | AUGACUAG CUGAUGAGGNNNNNNNNCCGAA AAAUAUAGG | 5398 |
| 7138 | CUAUAUUUC UAGUCAUG | 1243 | CAUGACUA CUGAUGAGGNNNNNNNNCCGAA AAAUAUAG | 5399 |
| 7140 | AUAUUUCUA GUCAUGAU | 1244 | AUCAUGAC CUGAUGAGGNNNNNNNNCCGAA AGAAAUAU | 5400 |
| 7143 | UUUCUAGUC AUGAUGAA | 1245 | UUCAUCAU CUGAUGAGGNNNNNNNNCCGAA ACUAGAAA | 5401 |
| 7155 | AUGAAUGUA UUUUGUAU | 1246 | AUACAAAA CUGAUGAGGNNNNNNNNCCGAA ACAUUCAU | 5402 |
| 7157 | GAAUGUAUU UGUAUACC | 1247 | GUAUACAA CUGAUGAGGNNNNNNNNCCGAA AUACAUUC | 5403 |
| 7158 | AAUGUAUUU UGUAUACC | 1248 | GGUAUACA CUGAUGAGGNNNNNNNNCCGAA AAUACAUU | 5404 |
| 7159 | AUGUAUUUU GUAUACCA | 1249 | UGGUAUAC CUGAUGAGGNNNNNNNNCCGAA AAAUACAU | 5405 |
| 7162 | UAUUUUGUA UACCAUCU | 1250 | AGAUGGUA CUGAUGAGGNNNNNNNNCCGAA ACAAAAUA | 5406 |
| 7164 | UUUUGUAUA CCAUCUUC | 1251 | GAAGAUGG CUGAUGAGGNNNNNNNNCCGAA AUACAAAA | 5407 |
| 7169 | UAUACCAUC UUCAUAUA | 1252 | UAUAUGAA CUGAUGAGGNNNNNNNNCCGAA AUGGUAUA | 5408 |
| 7171 | UACCAUCUU CAUAUAAU | 1253 | AUUAUAUG CUGAUGAGGNNNNNNNNCCGAA AGAUGGUA | 5409 |
| 7172 | ACCAUCUUC AUAUAAUA | 1254 | UAUUAUAU CUGAUGAGGNNNNNNNNCCGAA AAGAUGGU | 5410 |
| 7175 | AUCUUCAUA UAAUACU | 1255 | GUAUUAUA CUGAUGAGGNNNNNNNNCCGAA AUGAAGAU | 5411 |
| 7177 | CUUCAUAUA AUAUACUU | 1256 | AAGUAUAU CUGAUGAGGNNNNNNNNCCGAA AUAUGAAG | 5412 |
| 7180 | CAUAUAAUA UACUUAAA | 1257 | UUUAAGUA CUGAUGAGGNNNNNNNNCCGAA AUUAUAUG | 5413 |
| 7182 | UAUAAUAUA CUUAAAA | 1258 | UUUUUAAG CUGAUGAGGNNNNNNNNCCGAA AUAUUAUA | 5414 |
| 7185 | AAUAUACUU AAAAUAUU | 1259 | AUAUUUUA CUGAUGAGGNNNNNNNNCCGAA AGUAUAUU | 5415 |
| 7186 | AUAUACUUA AAAUAUU | 1260 | AAUAUUUU CUGAUGAGGNNNNNNNNCCGAA AAGUAUAU | 5416 |
| 7192 | UUAAAAAUA UUUCUUAA | 1261 | UUAAGAAA CUGAUGAGGNNNNNNNNCCGAA AUUUUUAA | 5417 |
| 7194 | AAAAAUAUU UCUUAAUU | 1262 | AAUUAAGA CUGAUGAGGNNNNNNNNCCGAA AUAUUUUU | 5418 |
| 7195 | AAAAUAUUU CUUAAUUG | 1263 | CAAUUAAG CUGAUGAGGNNNNNNNNCCGAA AAAUAUUUU | 5419 |
| 7196 | AAAUAUUUC UUAAUUGG | 1264 | CCAAUUAA CUGAUGAGGNNNNNNNNCCGAA AAAUAUUU | 5420 |
| 7198 | AUAUUUCUU AAUUGGGA | 1265 | UCCCAAUU CUGAUGAGGNNNNNNNNCCGAA AGAAAUAU | 5421 |
| 7199 | UAUUUCUUA AUUGGGAU | 1266 | AUCCCAAU CUGAUGAGGNNNNNNNNCCGAA AAGAAAUA | 5422 |
| 7202 | UUCUUAAUU GGGAUUUG | 1267 | CAAAUCCC CUGAUGAGGNNNNNNNNCCGAA AUUAAGAA | 5423 |
| 7208 | AUUGGGAUU UGUAAUCG | 1268 | CGAUUACA CUGAUGAGGNNNNNNNNCCGAA AUCCCAAU | 5424 |
| 7209 | UUGGGAUUU GUAAUCGU | 1269 | ACGAUUAC CUGAUGAGGNNNNNNNNCCGAA AAUCCCAA | 5425 |
| 7212 | GGAUUUGUA AUCGUACC | 1270 | GGUACGAU CUGAUGAGGNNNNNNNNCCGAA ACAAAUCC | 5426 |
| 7215 | UUUGUAAUC GUACCAAC | 1271 | GUUGGUAC CUGAUGAGGNNNNNNNNCCGAA AUUACAAA | 5427 |
| 7218 | GUAAUCGUA CCAACUUA | 1272 | UAAGUUGG CUGAUGAGGNNNNNNNNCCGAA ACGAUUAC | 5428 |
| 7225 | UACCAACUU AAUUGAUA | 1273 | UAUCAAUU CUGAUGAGGNNNNNNNNCCGAA AGUUGGUA | 5429 |
| 7226 | ACCAACUUA AUUGAUAA | 1274 | UUAUCAAU CUGAUGAGGNNNNNNNNCCGAA AAGUUGGU | 5430 |
| 7229 | AACUUAAUU GAUAAACU | 1275 | AGUUUAUC CUGAUGAGGNNNNNNNNCCGAA AUUAAGUU | 5431 |
| 7233 | UAAUUGAUA AACUUGGC | 1276 | GCCAAGUU CUGAUGAGGNNNNNNNNCCGAA AUCAAUUA | 5432 |
| 7238 | GAUAAACUU GGCAACUG | 1277 | CAGUUGCC CUGAUGAGGNNNNNNNNCCGAA AGUUUAUC | 5433 |
| 7249 | CAACUGCUU UAUGUUC | 1278 | GAACAUAA CUGAUGAGGNNNNNNNNCCGAA AGCAGUUG | 5434 |
| 7250 | AACUGCUUU UAUGUUCU | 1279 | AGAACAUA CUGAUGAGGNNNNNNNNCCGAA AAGCAGUU | 5435 |
| 7251 | ACUGCUUUU AUGUUCUG | 1280 | CAGAACAU CUGAUGAGGNNNNNNNNCCGAA AAAGCAGU | 5436 |
| 7252 | CUGCUUUUA UGUUCUGU | 1281 | ACAGAACA CUGAUGAGGNNNNNNNNCCGAA AAAAGCAG | 5437 |
| 7256 | UUUUAUGUU CUGUCUCC | 1282 | GGAGACAG CUGAUGAGGNNNNNNNNCCGAA ACAUAAAA | 5438 |
| 7257 | UUUAUGUUC UGUCUCCU | 1283 | AGGAGACA CUGAUGAGGNNNNNNNNCCGAA AACAUAAA | 5439 |
| 7261 | UGUUCUGUC UCCUUCCA | 1284 | UGGAAGGA CUGAUGAGGNNNNNNNNCCGAA ACAGAACA | 5440 |
| 7263 | UUCUGUCUC CUUCCAUA | 1285 | UAUGGAAG CUGAUGAGGNNNNNNNNCCGAA AGACAGAA | 5441 |
| 7266 | UGUCUCCUU CCAUAAAU | 1286 | AUUUAUGG CUGAUGAGGNNNNNNNNCCGAA AGGAGACA | 5442 |
| 7267 | GUCUCCUUC CAUAAAUU | 1287 | AAUUUAUG CUGAUGAGGNNNNNNNNCCGAA AAGGAGAC | 5443 |
| 7271 | CCUUCCAUA AAUUUUUC | 1288 | GAAAAAUU CUGAUGAGGNNNNNNNNCCGAA AUGGAAGG | 5444 |
| 7275 | CCAUAAAUU UUUCAAAA | 1289 | UUUUGAAA CUGAUGAGGNNNNNNNNCCGAA AUUUAUGG | 5445 |
| 7276 | CAUAAAUUU UUCAAAAU | 1290 | AUUUUGAA CUGAUGAGGNNNNNNNNCCGAA AAUUUAUG | 5446 |
| 7277 | AUAAAUUUU UCAAAAUA | 1291 | UAUUUUGA CUGAUGAGGNNNNNNNNCCGAA AAAUUUAU | 5447 |
| 7278 | UAAAUUUUU CAAAAUAC | 1292 | GUAUUUUG CUGAUGAGGNNNNNNNNCCGAA AAAAUUUA | 5448 |
| 7279 | AAAUUUUUC AAAAUACU | 1293 | AGUAUUUU CUGAUGAGGNNNNNNNNCCGAA AAAAAUUU | 5449 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7285 | UUCAAAAUA CUAAUUCA | 1294 | UGAAUUAG CUGAUGAGGNNNNNNNNCCGAA AUUUUGAA | 5450 |
| 7288 | AAAAUACUA AUUCAACA | 1295 | UGUUGAAU CUGAUGAGGNNNNNNNNCCGAA AGUAUUUU | 5451 |
| 7291 | AUACUAAUU CAACAAAG | 1296 | CUUUGUUG CUGAUGAGGNNNNNNNNCCGAA AUUAGUAU | 5452 |
| 7292 | UACUAAUUC AACAAAGA | 1297 | UCUUUGUU CUGAUGAGGNNNNNNNNCCGAA AAUUAGUA | 5453 |
| 7308 | AAAAAGCUC UUUUUUUU | 1298 | AAAAAAAA CUGAUGAGGNNNNNNNNCCGAA AGCUUUUU | 5454 |
| 7310 | AAAGCUCUU UUUUUCC | 1299 | GGAAAAAA CUGAUGAGGNNNNNNNNCCGAA AGAGCUUU | 5455 |
| 7311 | AAGCUCUUU UUUUUCCU | 1300 | AGGAAAAA CUGAUGAGGNNNNNNNNCCGAA AAGAGCUU | 5456 |
| 7312 | AGCUCUUUU UUUUCCUA | 1301 | UAGGAAAA CUGAUGAGGNNNNNNNNCCGAA AAAGAGCU | 5457 |
| 7313 | GCUCUUUUU UUUCCUAA | 1302 | UUAGGAAA CUGAUGAGGNNNNNNNNCCGAA AAAAGAGC | 5458 |
| 7314 | CUCUUUUUU UUCCUAAA | 1303 | UUUAGGAA CUGAUGAGGNNNNNNNNCCGAA AAAAAGAG | 5459 |
| 7315 | UCUUUUUUU UCCUAAAA | 1304 | UUUUAGGA CUGAUGAGGNNNNNNNNCCGAA AAAAAAGA | 5460 |
| 7316 | CUUUUUUUU CCUAAAAU | 1305 | AUUUUAGG CUGAUGAGGNNNNNNNNCCGAA AAAAAAAG | 5461 |
| 7317 | UUUUUUUUC CUAAAAUA | 1306 | UAUUUUAG CUGAUGAGGNNNNNNNNCCGAA AAAAAAAA | 5462 |
| 7320 | UUUUUCCUA AAAUAAAC | 1307 | GUUUAUUU CUGAUGAGGNNNNNNNNCCGAA AGGAAAAA | 5463 |
| 7325 | CCUAAAAUA AACUCAAA | 1308 | UUUGAGUU CUGAUGAGGNNNNNNNNCCGAA AUUUUAGG | 5464 |
| 7330 | AAUAAACUC AAAUUUAU | 1309 | AUAAAUUU CUGAUGAGGNNNNNNNNCCGAA AGUUUAUU | 5465 |
| 7335 | ACUCAAAUU UAUCCUUG | 1310 | CAAGGAUA CUGAUGAGGNNNNNNNNCCGAA AUUUGAGU | 5466 |
| 7336 | CUCAAAUUU AUCCUUGU | 1311 | ACAAGGAU CUGAUGAGGNNNNNNNNCCGAA AAUUUGAG | 5467 |
| 7337 | UCAAAUUUA UCCUUGUU | 1312 | AACAAGGA CUGAUGAGGNNNNNNNNCCGAA AAAUUUGA | 5468 |
| 7339 | AAAUUUAUC CUUGUUUA | 1313 | UAAACAAG CUGAUGAGGNNNNNNNNCCGAA AUAAAUUU | 5469 |
| 7342 | UUUAUCCUU GUUUAGAG | 1314 | CUCUAAAC CUGAUGAGGNNNNNNNNCCGAA AGGAUAAA | 5470 |
| 7345 | AUCCUUGUU UAGCAGA | 1315 | CUGCUCUA CUGAUGAGGNNNNNNNNCCGAA ACAAGGAU | 5471 |
| 7346 | UCCUUGUUU AGAGCAGA | 1316 | UCUGCUCU CUGAUGAGGNNNNNNNNCCGAA AACAAGGA | 5472 |
| 7347 | CCUUGUUUA GAGCAGAG | 1317 | CUCUGCUC CUGAUGAGGNNNNNNNNCCGAA AAACAAGG | 5473 |
| 7362 | AGAAAAAUU AAGAAAAA | 1318 | UUUUUCUU CUGAUGAGGNNNNNNNNCCGAA AUUUUUCU | 5474 |
| 7363 | GAAAAAUUA AGAAAAAC | 1319 | GUUUUUCU CUGAUGAGGNNNNNNNNCCGAA AAUUUUUC | 5475 |
| 7373 | GAAAAACUU UGAAAUGG | 1320 | CCAUUUCA CUGAUGAGGNNNNNNNNCCGAA AGUUUUUC | 5476 |
| 7374 | AAAAACUUU GAAAUGGU | 1321 | ACCAUUUC CUGAUGAGGNNNNNNNNCCGAA AAGUUUUU | 5477 |
| 7383 | GAAAUGGUC UCAAAAAA | 1322 | UUUUUUGA CUGAUGAGGNNNNNNNNCCGAA ACCAUUUC | 5478 |
| 7385 | AAUGGUCUC AAAAAAUU | 1323 | AAUUUUUU CUGAUGAGGNNNNNNNNCCGAA AGACCAUU | 5479 |
| 7393 | CAAAAAAUU GCUAAAUA | 1324 | UAUUUAGC CUGAUGAGGNNNNNNNNCCGAA AUUUUUUG | 5480 |
| 7397 | AAAUUGCUA AAUAUUUU | 1325 | AAAAUAUU CUGAUGAGGNNNNNNNNCCGAA AGCAAUUU | 5481 |
| 7401 | UGCUAAAUA UUUUCAAU | 1326 | AUUGAAAA CUGAUGAGGNNNNNNNNCCGAA AUUUAGCA | 5482 |
| 7403 | CUAAAUAUU UUCAAUGG | 1327 | CCAUUGAA CUGAUGAGGNNNNNNNNCCGAA AUAUUUAG | 5483 |
| 7404 | UAAAUAUUU UCAAUGGA | 1328 | UCCAUUGA CUGAUGAGGNNNNNNNNCCGAA AAUAUUUA | 5484 |
| 7405 | AAAUAUUUU CAAUGGAA | 1329 | UUCCAUUG CUGAUGAGGNNNNNNNNCCGAA AAAUAUUU | 5485 |
| 7406 | AAUAUUUUC AAUGGAAA | 1330 | UUUCCAUU CUGAUGAGGNNNNNNNNCCGAA AAAAUAUU | 5486 |
| 7418 | GGAAAACUA AAUGUUAG | 1331 | CUAACAUU CUGAUGAGGNNNNNNNNCCGAA AGUUUUCC | 5487 |
| 7424 | CUAAAUGUU AGCUAAAC | 1332 | GCUAAACU CUGAUGAGGNNNNNNNNCCGAA ACAUUUAG | 5488 |
| 7425 | UAAAUGUUA GUUUAGCU | 1333 | AGCUAAAC CUGAUGAGGNNNNNNNNCCGAA AACAUUUA | 5489 |
| 7428 | AUGUUAGUU UAGCUGAU | 1334 | AUCAGCUA CUGAUGAGGNNNNNNNNCCGAA ACUAACAU | 5490 |
| 7429 | UGUUAGUUU AGCUGAUU | 1335 | AAUCAGCU CUGAUGAGGNNNNNNNNCCGAA AACUAACA | 5491 |
| 7430 | GUUAGUUUA GCUGAUUG | 1336 | CAAUCAGC CUGAUGAGGNNNNNNNNCCGAA AAACUAAC | 5492 |
| 7437 | UAGCUGAUU GUAUGGGG | 1337 | CCCCAUAC CUGAUGAGGNNNNNNNNCCGAA AUCAGCUA | 5493 |
| 7440 | CUGAUUGUA UGGGGUUU | 1338 | AAACCCCA CUGAUGAGGNNNNNNNNCCGAA ACAAUCAG | 5494 |
| 7447 | UAUGGGGUU UUCGAACC | 1339 | GGUUCGAA CUGAUGAGGNNNNNNNNCCGAA ACCCCAUA | 5495 |
| 7448 | AUGGGGUUU UCGAACCU | 1340 | AGGUUCGA CUGAUGAGGNNNNNNNNCCGAA AACCCCAU | 5496 |
| 7449 | UGGGGUUUU CGAACCUU | 1341 | AAGGUUCG CUGAUGAGGNNNNNNNNCCGAA AAACCCCA | 5497 |
| 7450 | GGGGUUUUC GAACCUUU | 1342 | AAAGGUUC CUGAUGAGGNNNNNNNNCCGAA AAAACCCC | 5498 |
| 7457 | UCGAACCUU UCACUUUU | 1343 | AAAAGUGA CUGAUGAGGNNNNNNNNCCGAA AGGUUCGA | 5499 |
| 7458 | CGAACCUUU CACUUUUU | 1344 | AAAAAGUG CUGAUGAGGNNNNNNNNCCGAA AAGGUUCG | 5500 |
| 7459 | GAACCUUUC ACUUUUUG | 1345 | CAAAAAGU CUGAUGAGGNNNNNNNNCCGAA AAAGGUUC | 5501 |
| 7463 | CUUUCACUU UUUGUUUG | 1346 | CAAACAAA CUGAUGAGGNNNNNNNNCCGAA AGUGAAAG | 5502 |
| 7464 | UUUCACUUU UUGUUUGU | 1347 | ACAAACAA CUGAUGAGGNNNNNNNNCCGAA AAGUGAAA | 5503 |
| 7465 | UUCACUUUU UGUUUGUU | 1348 | AACAAACA CUGAUGAGGNNNNNNNNCCGAA AAAGUGAA | 5504 |
| 7466 | UCACUUUUU GUUUGUUU | 1349 | AAACAAAC CUGAUGAGGNNNNNNNNCCGAA AAAAGUGA | 5505 |
| 7469 | CUUUUUGUU UGUUUUAC | 1350 | GUAAAACA CUGAUGAGGNNNNNNNNCCGAA ACAAAAAG | 5506 |
| 7470 | UUUUUGUUU GUUUUACC | 1351 | GGUAAAAC CUGAUGAGGNNNNNNNNCCGAA AACAAAAA | 5507 |
| 7473 | UUGUUUGUU UUACCUAU | 1352 | AUAGGUAA CUGAUGAGGNNNNNNNNCCGAA ACAAACAA | 5508 |
| 7474 | UGUUUGUUU UACCAUU | 1353 | AAUAGGUA CUGAUGAGGNNNNNNNNCCGAA AACAAACA | 5509 |
| 7475 | GUUUGUUUU ACCAUUU | 1354 | AAAUAGGU CUGAUGAGGNNNNNNNNCCGAA AAACAAAC | 5510 |
| 7476 | UUUGUUUUA CCAUUUC | 1355 | GAAAUAGG CUGAUGAGGNNNNNNNNCCGAA AAAACAAA | 5511 |
| 7480 | UUUUACCUA UUUCACAA | 1356 | UUGUGAAA CUGAUGAGGNNNNNNNNCCGAA AGGUAAAA | 5512 |
| 7482 | UUACCUAUU UCACAACU | 1357 | AGUUGUGA CUGAUGAGGNNNNNNNNCCGAA AUAGGUAA | 5513 |
| 7483 | UACCUAUUU CACAACUG | 1358 | CAGUUGUG CUGAUGAGGNNNNNNNNCCGAA AAUAGGUA | 5514 |
| 7484 | ACCUAUUUC ACAACUGU | 1359 | ACAGUUGU CUGAUGAGGNNNNNNNNCCGAA AAAUAGGU | 5515 |
| 7495 | AACUGUGUA AAUGCCAA | 1360 | UGGCAAUU CUGAUGAGGNNNNNNNNCCGAA ACACAGUU | 5516 |
| 7499 | GUGUAAAUG GCCAAUAA | 1361 | UUAUUGGC CUGAUGAGGNNNNNNNNCCGAA AUUUACAC | 5517 |
| 7506 | UUGCCAAUA AUUCCUGU | 1362 | ACAGGAAU CUGAUGAGGNNNNNNNNCCGAA AUUGGCAA | 5518 |
| 7509 | CCAAUAAUU CCUGUCCA | 1363 | UGGACAGG CUGAUGAGGNNNNNNNNCCGAA AUUAUUGG | 5519 |
| 7510 | CAAUAAUUC CUGUCCAU | 1364 | AUGGACAG CUGAUGAGGNNNNNNNNCCGAA AAUUAUUG | 5520 |
| 7515 | AUCCUGUC CAUGAAAA | 1365 | UUUUCAUG CUGAUGAGGNNNNNNNNCCGAA ACAGGAAU | 5521 |
| 7531 | AUGCAAAUU AUCCAGUG | 1366 | CACUGGAU CUGAUGAGGNNNNNNNNCCGAA AUUUGCAU | 5522 |

TABLE II-continued

Human flt1 VEGF Receptor-Hammerhead Ribozyme and Substrate Sequence

| Pos | Substrate | Seq ID No | HH Ribozyme | Seq ID No |
|---|---|---|---|---|
| 7532 | UGCAAAUUA UCCAGUGU | 1367 | ACACUGGA CUGAUGAGGNNNNNNNNCCGAA AAUUUGCA | 5523 |
| 7534 | CAAAUUAUC CAGUGUAG | 1368 | CUACACUG CUGAUGAGGNNNNNNNNCCGAA AUAAUUUG | 5524 |
| 7541 | UCCAGUGUA GAUAUAUU | 1369 | AAUAUAUC CUGAUGAGGNNNNNNNNCCGAA ACACUGGA | 5525 |
| 7545 | GUGUAGAUA UAUUUGAC | 1370 | GUCAAAUA CUGAUGAGGNNNNNNNNCCGAA AUCUACAC | 5526 |
| 7547 | GUAGAUAUA UUUGACCA | 1371 | UGGUCAAA CUGAUGAGGNNNNNNNNCCGAA AUAUCUAC | 5527 |
| 7549 | AGAUAUAUU UGACCAUC | 1372 | GAUGGUCA CUGAUGAGGNNNNNNNNCCGAA AUAUAUCU | 5528 |
| 7550 | GAUAUAUUU GACCAUCA | 1373 | UGAUGGUC CUGAUGAGGNNNNNNNNCCGAA AAUAUAUC | 5529 |
| 7557 | UUGACCAUC ACCCUAUG | 1374 | CAUAGGGU CUGAUGAGGNNNNNNNNCCGAA AUGGUCAA | 5530 |
| 7563 | AUCACCCUA UGGAUAUU | 1375 | AAUAUCCA CUGAUGAGGNNNNNNNNCCGAA AGGGUGAU | 5531 |
| 7569 | CUAUGGAUA UUGGCUAG | 1376 | CUAGCCAA CUGAUGAGGNNNNNNNNCCGAA AUCCAUAG | 5532 |
| 7571 | AUGGAUAUU GGCUAGUU | 1377 | AACUAGCC CUGAUGAGGNNNNNNNNCCGAA AUAUCCAU | 5533 |
| 7576 | UAUGGCUA GUUUGCC | 1378 | GGCAAAAC CUGAUGAGGNNNNNNNNCCGAA AGCCAUA | 5534 |
| 7579 | UGGCUAGUU UUGCCUUU | 1379 | AAAGGCAA CUGAUGAGGNNNNNNNNCCGAA ACUAGCCA | 5535 |
| 7580 | GGCUAGUUU UGCCUUUA | 1380 | UAAAGGCA CUGAUGAGGNNNNNNNNCCGAA AACUAGCC | 5536 |
| 7581 | GCUAGUUUU GCCUUUAU | 1381 | AUAAAGGC CUGAUGAGGNNNNNNNNCCGAA AAACUAGC | 5537 |
| 7586 | UUUUGCCUU UAUUAAGC | 1382 | GCUUAAUA CUGAUGAGGNNNNNNNNCCGAA AGGCAAAA | 5538 |
| 7587 | UUUGCCUUU AUUAAGCA | 1383 | UGCUUAAU CUGAUGAGGNNNNNNNNCCGAA AAGGCAAA | 5539 |
| 7588 | UUGCCUUUA UUAAGCAA | 1384 | UUGCUUAA CUGAUGAGGNNNNNNNNCCGAA AAAGGCAA | 5540 |
| 7590 | GCCUUUAUU AAGCAAAU | 1385 | AUUUGCUU CUGAUGAGGNNNNNNNNCCGAA AUAAAGGC | 5541 |
| 7591 | CCUUUAUUA AGCAAAUU | 1386 | AAUUUGCU CUGAUGAGGNNNNNNNNCCGAA AAUAAAGG | 5542 |
| 7599 | AAGCAAAUU CAUUUCAG | 1387 | CUGAAAUG CUGAUGAGGNNNNNNNNCCGAA AUUUGCUU | 5543 |
| 7600 | AGCAAAUUC AUUUCAGC | 1388 | GCUGAAAU CUGAUGAGGNNNNNNNNCCGAA AAUUUGCU | 5544 |
| 7603 | AAAUUCAUU UCAGCCUG | 1389 | CAGGCUGA CUGAUGAGGNNNNNNNNCCGAA AUGAAUUU | 5545 |
| 7604 | AAUUCAUUU CAGCCUGA | 1390 | UCAGGCUG CUGAUGAGGNNNNNNNNCCGAA AAUGAAUU | 5546 |
| 7605 | AUUCAUUUC AGCCUGAA | 1391 | UUCAGGCU CUGAUGAGGNNNNNNNNCCGAA AAAUGAAU | 5547 |
| 7617 | CUGAAUGUC UGCCUAUA | 1392 | UAUAGGCA CUGAUGAGGNNNNNNNNCCGAA ACAUUCAG | 5548 |
| 7623 | GUCUGCCUA UAUAUUCU | 1393 | AGAAUAUA CUGAUGAGGNNNNNNNNCCGAA AGGCAGAC | 5549 |
| 7625 | CUGCCUAUA UAUUCUCU | 1394 | AGAGAAUA CUGAUGAGGNNNNNNNNCCGAA AUAGGCAG | 5550 |
| 7627 | GCCUAUAUA UUCUCUGC | 1395 | GCAGAGAA CUGAUGAGGNNNNNNNNCCGAA AUAUAGGC | 5551 |
| 7629 | CUAUAUAUU CUCUGCUC | 1396 | GAGCAGAG CUGAUGAGGNNNNNNNNCCGAA AUAUAUAG | 5552 |
| 7630 | UAUAUAUUC UCUGCUCU | 1397 | AGAGCAGA CUGAUGAGGNNNNNNNNCCGAA AAUAUAUA | 5553 |
| 7632 | UAUAUUCUC UGCUCUUU | 1398 | AAAGAGCA CUGAUGAGGNNNNNNNNCCGAA AGAAUAUA | 5554 |
| 7637 | UCUCUGCUC UUUGUAUU | 1399 | AAUACAAA CUGAUGAGGNNNNNNNNCCGAA AGCAGAGA | 5555 |
| 7639 | UCUGCUCUU UGUAUUCU | 1400 | AGAAUACA CUGAUGAGGNNNNNNNNCCGAA AGAGCAGA | 5556 |
| 7640 | CUGCUCUUU GUAUUCUC | 1401 | GAGAAUAC CUGAUGAGGNNNNNNNNCCGAA AAGAGCAG | 5557 |
| 7643 | CUCUUUGUA UUCUCCUU | 1402 | AAGGAGAA CUGAUGAGGNNNNNNNNCCGAA ACAAAGAG | 5558 |
| 7645 | CUUUGUAUU CUCCUUUG | 1403 | CAAAGGAG CUGAUGAGGNNNNNNNNCCGAA AUACAAAG | 5559 |
| 7646 | UUUGUAUUC UCCUUUGA | 1404 | UCAAAGGA CUGAUGAGGNNNNNNNNCCGAA AAUACAAA | 5560 |
| 7648 | UGUAUUCUC CUUUGAAC | 1405 | GUUCAAAG CUGAUGAGGNNNNNNNNCCGAA AGAAUACA | 5561 |
| 7651 | AUUCUCCUU UGAACCCG | 1406 | CGGGUUCA CUGAUGAGGNNNNNNNNCCGAA AGGAGAAU | 5562 |
| 7652 | UUCUCCUUU GAACCCGU | 1407 | ACGGGUUC CUGAUGAGGNNNNNNNNCCGAA AAGGAGAA | 5563 |
| 7661 | GAACCCGUU AAAACAUC | 1408 | GAUGUUUU CUGAUGAGGNNNNNNNNCCGAA ACGGGUUC | 5564 |
| 7662 | AACCCGUUA AAACAUCC | 1409 | GGAUGUUU CUGAUGAGGNNNNNNNNCCGAA AACGGGUU | 5565 |
| 7669 | UAAAACAUC CUGUGGCA | 1410 | UGCCACAG CUGAUGAGGNNNNNNNNCCGAA AUGUUUUA | 5566 |

Where "X" represents stem II region of a HH ribozyme (Hertel et al., 1992 Nucleic Acids Res. 20 3252). The length of stem II may be ≧2 base-pairs. Underlined region can be any X sequence or linker, as described herein.

TABLE III

Human flt1 VEGF Receptor-Hairpin Ribozyme and Substrate sequence

| Pos | Substrate | Seq ID No | HP Ribozyme Sequence | Seq ID No |
|---|---|---|---|---|
| 16 | CCUCUCG GCU CCUCCCCG | 1411 | CGGGGAGG AGAA GAGAGG ACCAGAGAAACACACGUUGUGGUACAUUACCUGGUA | 5567 |
| 39 | GGCGGCG GCU CGGAGCGG | 1412 | CCGCCGCG AGAA CCGCCGCC ACCAGAGAAACACACGUUGUGGUACAUUACCUGGUA | 5568 |
| 180 | GAGGACG GAC UCUGGCGG | 1413 | CCGCCAGA AGAA GUCCUC ACCAGAGAAACACACGUUGUGGUACAUUACCUGGUA | 5569 |
| 190 | UCUGGCG GCC GGGUCGUU | 1414 | AACGACCC AGAA GCCAGA ACCAGAGAAACACACGUUGUGGUACAUUACCUGGUA | 5570 |
| 278 | GGGUCCU GCU GUGCGCGC | 1415 | GCGCGCAC AGAA GGACCC ACCAGAGAAACACACGUUGUGGUACAUUACCUGGUA | 5571 |
| 290 | GCGCGCU GCU CAGCUGUC | 1416 | GACACUG AGAA GCGCGC ACCAGAGAAACACACGUUGUGGUACAUUACCUGGUA | 5572 |
| 295 | CUGCUCA GCU GUCUGCUU | 1417 | AAGCAGAC AGAA GAGCAG ACCAGAGAAACACACGUUGUGGUACAUUACCUGGUA | 5573 |
| 298 | CUCAGCU GUC UGCUUCUC | 1418 | GAGAAGCA AGAA GCUAGA ACCAGAGAAACACACGUUGUGGUACAUUACCUGGUA | 5574 |
| 302 | GCUGUCU GCU UCUCACAG | 1419 | CUGUGAGA AGAA GACAGC ACCAGAGAAACACACGUUGUGGUACAUUACCUGGUA | 5575 |
| 420 | GGAAGCA GCU CAUAAAUG | 1420 | CAUUUAUG AGAA GCUUCC ACCAGAGAAACACACGUUGUGGUACAUUACCUGGUA | 5576 |
| 486 | UAAAUCU GCC UGUGGAAG | 1421 | CUUCCACA AGAA GAUUUA ACCAGAGAAACACACGUUGUGGUACAUUACCUGGUA | 5577 |
| 537 | GAACACA GCU CAAGCAAA | 1422 | UUUGCUUG AGAA GUGUUC ACCAGAGAAACACACGUUGUGGUACAUUACCUGGUA | 5578 |
| 565 | UUCUACA GCU GCAAAUAU | 1423 | AUAUUUGC AGAA GUAGAA ACCAGAGAAACACACGUUGUGGUACAUUACCUGGUA | 5579 |
| 721 | AUUCCCU GCC GGGUUACG | 1424 | CGUAACCC AGAA GGGAAU ACCAGAGAAACACACGUUGUGGUACAUUACCUGGUA | 5580 |
| 786 | GAUCCCU GAU GGAAAACG | 1425 | CGUUUUCC AGAA GGGAUC ACCAGAGAAACACACGUUGUGGUACAUUACCUGGUA | 5581 |

TABLE III-continued

Human flt1 VEGF Receptor-Hairpin Ribozyme and Substrate sequence

| Pos | Substrate | Seq ID No | HP Ribozyme Sequence | Seq ID No |
|---|---|---|---|---|
| 863 | GGCUUCU GAC CUGUGAAG | 1426 | CUUCACAG AGAA GAAGCC ACCAGAGAAACACACGUUGUGGUACAUUACCUGGUA | 5582 |
| 1056 | UUACCCU GAU GAAAAAAA | 1427 | UUUUUUUC AGAA GGGUAA ACCAGAGAAACACACGUUGUGGUACAUUACCUGGUA | 5583 |
| 1301 | GCAAGCG GUC UUACCGGC | 1428 | GCCGGUAA AGAA GCUUGC ACCAGAGAAACACACGUUGUGGUACAUUACCUGGUA | 5584 |
| 1310 | CUUACCG GCU CUCUAUGA | 1429 | UCAUAGAG AGAA GGUAAG ACCAGAGAAACACACGUUGUGGUACAUUACCUGGUA | 5585 |
| 1389 | GAAAUCU GCU CGCUAUUU | 1430 | AAAUAGCG AGAA GAUUUC ACCAGAGAAACACACGUUGUGGUACAUUACCUGGUA | 5586 |
| 1535 | AACCCCA GAU UUACGAAA | 1431 | UUUCGUAA AGAA GGGGUU ACCAGAGAAACACACGUUGUGGUACAUUACCUGGUA | 5587 |
| 1566 | GUUUCCA GAC CCGGCUCU | 1432 | AGAGCCGG AGAA GGAAAC ACCAGAGAAACACACGUUGUGGUACAUUACCUGGUA | 5588 |
| 1572 | AGACCCG GCU CUCUACCC | 1433 | GGGUAGAG AGAA GGGUCU ACCAGAGAAACACACGUUGUGGUACAUUACCUGGUA | 5589 |
| 1604 | AAAUCCU GAC UUGUACCG | 1434 | CGGUACAA AGAA GGAUUU ACCAGAGAAACACACGUUGUGGUACAUUACCUGGUA | 5590 |
| 1824 | UGUGGCU GAC UCUAGAAU | 1435 | AUUCUAGA AGAA GCCACA ACCAGAGAAACACACGUUGUGGUACAUUACCUGGUA | 5591 |
| 1908 | UAUCACA GAU GUGCCAAA | 1436 | UUUGGCAC AGAA GUGAUA ACCAGAGAAACACACGUUGUGGUACAUUACCUGGUA | 5592 |
| 1949 | AAAUGCC GAC GGAAGGAG | 1437 | CUCCUUCC AGAA GCAUUU ACCAGAGAAACACACGUUGUGGUACAUUACCUGGUA | 5593 |
| 1973 | UGAAACU GUC UUGCACAG | 1438 | CUGUGCAA AGAA GUUUCA ACCAGAGAAACACACGUUGUGGUACAUUACCUGGUA | 5594 |
| 2275 | AUCAGCA GAU CCACCACU | 1439 | AGUGGUGG AGAA GCUGAU ACCAGAGAAACACACGUUGUGGUACAUUACCUGGUA | 5595 |
| 2321 | AGCCUCA GAU CACUUGGU | 1440 | ACCAAGUG AGAA GAGGCU ACCAGAGAAACACACGUUGUGGUACAUUACCUGGUA | 5596 |
| 2396 | GCACGCU GUU UAUUGAAA | 1441 | UUUCAAUA AGAA GCGUGC ACCAGAGAAACACACGUUGUGGUACAUUACCUGGUA | 5597 |
| 2490 | CCUCACU GUU CAAGGAAC | 1442 | GUUCCUUG AGAA GUGAGG ACCAGAGAAACACACGUUGUGGUACAUUACCUGGUA | 5598 |
| 2525 | UGGAGCU GAU CACUCUAA | 1443 | UUAGAGUG AGAA GCUCCA ACCAGAGAAACACACGUUGUGGUACAUUACCUGGUA | 5599 |
| 2625 | AAAGACU GAC UACCUAUC | 1444 | GAUAGGUA AGAA GUCUUU ACCAGAGAAACACACGUUGUGGUACAUUACCUGGUA | 5600 |
| 2652 | GGACCCA GAU GAAGUUCC | 1445 | GGAACUUC AGAA GGGUCC ACCAGAGAAACACACGUUGUGGUACAUUACCUGGUA | 5601 |
| 2684 | GUGAGCG GCU CCCUUAUG | 1446 | CAUAAGGG AGAA GCUCAC ACCAGAGAAACACACGUUGUGGUACAUUACCUGGUA | 5602 |
| 2816 | CGUGCCG GAC GUGGCUG | 1447 | CAGCCACA AGAA GGCACG ACCAGAGAAACACACGUUGUGGUACAUUACCUGGUA | 5603 |
| 2873 | AAGCUCU GAU GACUGAGC | 1448 | GCUCAGUC AGAA GAGCUU ACCAGAGAAACACACGUUGUGGUACAUUACCUGGUA | 5604 |
| 2930 | UUAACCU GCU GGGAGCCU | 1449 | AGGCUCCC AGAA GGUUAA ACCAGAGAAACACACGUUGUGGUACAUUACCUGGUA | 5605 |
| 2963 | GGCCUCU GAU GGUGAUUG | 1450 | CAAUCACC AGAA GAGGCC ACCAGAGAAACACACGUUGUGGUACAUUACCUGGUA | 5606 |
| 3157 | AGCUCCG GCU UUCAGGAA | 1451 | UUCCUGAA AGAA GGAGCU ACCAGAGAAACACACGUUGUGGUACAUUACCUGGUA | 5607 |
| 3207 | GGAUUCU GAC GGUUUCUA | 1452 | UAGAAACC AGAA GAAUCC ACCAGAGAAACACACGUUGUGGUACAUUACCUGGUA | 5608 |
| 3211 | UCUGACG GUU UCUACAAG | 1453 | CUUGUAGA AGAA GUCAGA ACCAGAGAAACACACGUUGUGGUACAUUACCUGGUA | 5609 |
| 3245 | AAGAUCU GAU UUCUUACA | 1454 | UGUAAGAA AGAA GAUCUU ACCAGAGAAACACACGUUGUGGUACAUUACCUGGUA | 5610 |
| 3256 | UCUUACA GUU UUCAAGUG | 1455 | CACUUGAA AGAA GUAAGA ACCAGAGAAACACACGUUGUGGUACAUUACCUGGUA | 5611 |
| 3287 | AGUUCCU GUC UUCCAGAA | 1456 | UUCUGGAA AGAA GGAACU ACCAGAGAAACACACGUUGUGGUACAUUACCUGGUA | 5612 |
| 3402 | GAACCCC GAU UAUGUGAG | 1457 | CUCACAUA AGAA GGGUUC ACCAGAGAAACACACGUUGUGGUACAUUACCUGGUA | 5613 |
| 3580 | UUUUGCA GUC GCCUGAGG | 1458 | CCUCAGGC AGAA GCAAAA ACCAGAGAAACACACGUUGUGGUACAUUACCUGGUA | 5614 |
| 3641 | UCUAUCA GAU CAUGCUGG | 1459 | CCAGCAUG AGAA GAUAGA ACCAGAGAAACACACGUUGUGGUACAUUACCUGGUA | 5615 |
| 3655 | CUGGACU GCU GGCACAGA | 1460 | UCUGUGCC AGAA GUCCAG ACCAGAGAAACACACGUUGUGGUACAUUACCUGGUA | 5616 |
| 3810 | AACUCCU GCC UUCUCUGA | 1461 | UCAGAGAA AGAA GGAGUU ACCAGAGAAACACACGUUGUGGUACAUUACCUGGUA | 5617 |
| 3846 | UAUUUCA GCU CCGAAGUU | 1462 | AACUUCGG AGAA GAAAUA ACCAGAGAAACACACGUUGUGGUACAUUACCUGGUA | 5618 |
| 3873 | AAGCUCU GAU GAUGUCAG | 1463 | CUGACAUC AGAA GAGCUU ACCAGAGAAACACACGUUGUGGUACAUUACCUGGUA | 5619 |
| 3995 | GCACUCU GUU GGCCUCUC | 1464 | GAGAGGCC AGAA GAGUGC ACCAGAGAAACACACGUUGUGGUACAUUACCUGGUA | 5620 |
| 4100 | CGGGGCU GUC UGAUGUCA | 1465 | UGACAUCA AGAA GCCCCG ACCAGAGAAACACACGUUGUGGUACAUUACCUGGUA | 5621 |
| 4104 | GCUGUCU GAU GUCAGCAG | 1466 | CUGCUGAC AGAA GACAGC ACCAGAGAAACACACGUUGUGGUACAUUACCUGGUA | 5622 |
| 4120 | AGGCCCA GUU UCUGCCAU | 1467 | AUGGCAGA AGAA GGGCCU ACCAGAGAAACACACGUUGUGGUACAUUACCUGGUA | 5623 |
| 4135 | CAUUCCA GCU GUGGGCAC | 1468 | GUGCCCAC AGAA GGAAUG ACCAGAGAAACACACGUUGUGGUACAUUACCUGGUA | 5624 |
| 4210 | GCGUGCU GCU CCCCGCCC | 1469 | GGGCGGGG AGAA GCACGC ACCAGAGAAACACACGUUGUGGUACAUUACCUGGUA | 5625 |
| 4217 | GCUCCCC GCC CCCAGACU | 1470 | AGUCUGGG AGAA GGGGAGC ACCAGAGAAACACACGUUGUGGUACAUUACCUGGUA | 5626 |
| 4224 | GCCCCCA GAC UACAACUC | 1471 | GAGUUGUA AGAA GGGGGC ACCAGAGAAACACACGUUGUGGUACAUUACCUGGUA | 5627 |
| 4382 | GGAGCCA GCU GCUUUUUG | 1472 | CAAAAAGC AGAA GGCUCC ACCAGAGAAACACACGUUGUGGUACAUUACCUGGUA | 5628 |
| 4385 | GCCAGCU GCU UUUUGUGA | 1473 | UCACAAAA AGAA GCUGGC ACCAGAGAAACACACGUUGUGGUACAUUACCUGGUA | 5629 |
| 4537 | CUUCCCU GCU CCAACCCC | 1474 | GGGGUUGG AGAA GGGAAG ACCAGAGAAACACACGUUGUGGUACAUUACCUGGUA | 5630 |
| 4573 | AGGACCA GUU UGAUUGAG | 1475 | CUCAAUCA AGAA GGUCCU ACCAGAGAAACACACGUUGUGGUACAUUACCUGGUA | 5631 |
| 4594 | CUGCACU GAU CACCCAAU | 1476 | AUUGGGUG AGAA GUGCAG ACCAGAGAAACACACGUUGUGGUACAUUACCUGGUA | 5632 |
| 4628 | UGGGCCA GCC CUGCAGCC | 1477 | GGCUGCAG AGAA GGCCCA ACCAGAGAAACACACGUUGUGGUACAUUACCUGGUA | 5633 |
| 4636 | CCCUGCA GCC CAAAACCC | 1478 | GGGUUUUG AGAA GCAGGG ACCAGAGAAACACACGUUGUGGUACAUUACCUGGUA | 5634 |
| 4866 | CUUCCCA GCU CUGACCCU | 1479 | AGGGUCAG AGAA GGGAAG ACCAGAGAAACACACGUUGUGGUACAUUACCUGGUA | 5635 |
| 4871 | CAGCUCU GAC CCUUCUAC | 1480 | GUAGAAGG AGAA GAGCUG ACCAGAGAAACACACGUUGUGGUACAUUACCUGGUA | 5636 |
| 4905 | AGGAGCA GAU GGACAGCG | 1481 | CGCUGUCC AGAA GCUCCU ACCAGAGAAACACACGUUGUGGUACAUUACCUGGUA | 5637 |
| 5233 | UUAUUCU GUU UUGCACAG | 1482 | CUGUGCAA AGAA GAAUAA ACCAGAGAAACACACGUUGUGGUACAUUACCUGGUA | 5638 |
| 5281 | AAAUGCA GUC CUGAGGAG | 1483 | CUCCUCAG AGAA GCAUUU ACCAGAGAAACACACGUUGUGGUACAUUACCUGGUA | 5639 |
| 5319 | GAGGGCU GAU GGAGGAAA | 1484 | UUUCCUCC AGAA GCCCUC ACCAGAGAAACACACGUUGUGGUACAUUACCUGGUA | 5640 |
| 5358 | AGACCCC GUC UCUAUACC | 1485 | GGUAUAGA AGAA GGGUCU ACCAGAGAAACACACGUUGUGGUACAUUACCUGGUA | 5641 |
| 5392 | CAACACA GUU GGGACCCA | 1486 | UGGGUCCC AGAA GUGUUG ACCAGAGAAACACACGUUGUGGUACAUUACCUGGUA | 5642 |
| 5563 | UUCUCCA GUU GGGACUCA | 1487 | UGAGUCCC AGAA GGAGAA ACCAGAGAAACACACGUUGUGGUACAUUACCUGGUA | 5643 |
| 5622 | UUCAACU GCU UUGAAACU | 1488 | AGUUUCAA AGAA GUUGAA ACCAGAGAAACACACGUUGUGGUACAUUACCUGGUA | 5644 |
| 5738 | UGGCUCU GUU UGAUGCUA | 1489 | UAGCAUCA AGAA GAGCCA ACCAGAGAAACACACGUUGUGGUACAUUACCUGGUA | 5645 |
| 5838 | UGGCUCU GUU UGAUGCUA | 1489 | UAGCAUCA AGAA GAGCCA ACCAGAGAAACACACGUUGUGGUACAUUACCUGGUA | 5645 |
| 5933 | GAUUGCU GCU UCUUGGGG | 1490 | CCCCAAGA AGAA GCAAUC ACCAGAGAAACACACGUUGUGGUACAUUACCUGGUA | 5646 |
| 6022 | UGCCUCU GUU CUUAUGUG | 1491 | CACAUAAG AGAA GAGGCA ACCAGAGAAACACACGUUGUGGUACAUUACCUGGUA | 5647 |
| 6120 | GGCAGCG GCU UUUGUGGA | 1492 | UCCACAAA AGAA GCUGCC ACCAGAGAAACACACGUUGUGGUACAUUACCUGGUA | 5648 |
| 6163 | UGGGACA GUC CUCUCCAC | 1493 | GUGGAGAG AGAA GUCCCA ACCAGAGAAACACACGUUGUGGUACAUUACCUGGUA | 5649 |
| 6270 | UGUGACA GCU GGCAAUUU | 1494 | AAAUUGCC AGAA GUCACA ACCAGAGAAACACACGUUGUGGUACAUUACCUGGUA | 5650 |
| 6412 | CUUAGCU GUU CAUGUCUU | 1495 | AAGACAUG AGAA GCUAAG ACCAGAGAAACACACGUUGUGGUACAUUACCUGGUA | 5651 |
| 6511 | UUACUCA GCU CCUUCAAA | 1496 | UUUGAAGG AGAA GAGUAA ACCAGAGAAACACACGUUGUGGUACAUUACCUGGUA | 5652 |
| 6778 | UGGAACA GUC UGGGUGGA | 1497 | UCCACCCA AGAA GUUCCA ACCAGAGAAACACACGUUGUGGUACAUUACCUGGUA | 5653 |

TABLE III-continued

Human flt1 VEGF Receptor-Hairpin Ribozyme and Substrate sequence

| Pos | Substrate | Seq ID No | HP Ribozyme Sequence | Seq ID No |
|---|---|---|---|---|
| 6826 | CUUGUCA GUC CAAGAAGU | 1498 | ACUUCUUG AGAA GACAAG ACCAGAGAAACACACGUUGUGGUACAUUACCUGGUA | 5654 |
| 7245 | GGCAACU GCU UUUAUGUU | 1499 | AACAUAAA AGAA GUUGCC ACCAGAGAAACACACGUUGUGGUACAUUACCUGGUA | 5655 |
| 7258 | AUGUUCU GUC UCCUUCCA | 1500 | UGGAAGGA AGAA GAACAU ACCAGAGAAACACACGUUGUGGUACAUUACCUGGUA | 5656 |
| 7433 | UUUAGCU GAU UGUAUGGG | 1501 | CCCAUACA AGAA GCUAAA ACCAGAGAAACACACGUUGUGGUACAUUACCUGGUA | 5657 |
| 7512 | AAUUCCU GUC CAUGAAAA | 1502 | UUUUCAUG AGAA GGAAUU ACCAGAGAAACACACGUUGUGGUACAUUACCUGGUA | 5658 |
| 7606 | CAUUUCA GCC UGAAUGUC | 1503 | GACAUUCA AGAA GAAAUG ACCAGAGAAACACACGUUGUGGUACAUUACCUGGUA | 5659 |
| 7618 | AAUGUCU GCC UAUAUAUU | 1504 | AAUAUAUA AGAA GACAUU ACCAGAGAAACACACGUUGUGGUACAUUACCUGGUA | 5660 |
| 7633 | AUUCUCU GCU CUUUGUAU | 1505 | AUACAAAG AGAA GAGAAU ACCAGAGAAACACACGUUGUGGUACAUUACCUGGUA | 5661 |

TABLE IV

Human KDR VEGF Receptor-Hammerhead Ribozyme and Substrate Sequence

| Pos | Substrate | Seq ID No | HH Ribozyme Sequence | Seq ID No |
|---|---|---|---|---|
| 21 | CUGGCCGUC GCCCUGUG | 1506 | CACAGGGC CUGAUGAGgNNNNNNNNCCGAA ACGGCCAG | 5662 |
| 33 | CUGUGGCUC UGCGUGGA | 1507 | UCCACGCA CUGAUGAGgNNNNNNNNCCGAA AGCCACAG | 5663 |
| 56 | GGCCGCCUC UGUGGGUU | 1508 | AACCCACA CUGAUGAGgNNNNNNNNCCGAA AGGCGGCC | 5664 |
| 64 | CUGUGGGUU UGCCUAGU | 1509 | ACUAGGCA CUGAUGAGgNNNNNNNNCCGAA ACCCACAG | 5665 |
| 65 | UGUGGGUUU GCCUAGUG | 1510 | CACUAGGC CUGAUGAGgNNNNNNNNCCGAA AACCCACA | 5666 |
| 70 | GUUUGCCUA GUGUUUCU | 1511 | AGAAACAC CUGAUGAGgNNNNNNNNCCGAA AGGCAAAC | 5667 |
| 75 | CCUAGUGUU UCUCUUGA | 1512 | UCAAGAGA CUGAUGAGgNNNNNNNNCCGAA ACACUAGG | 5668 |
| 76 | CUAGUGUUU CUCUUGAU | 1513 | AUCAAGAG CUGAUGAGgNNNNNNNNCCGAA AACACUAG | 5669 |
| 77 | UAGUGUUUC UCUUGAUC | 1514 | GAUCAAGA CUGAUGAGgNNNNNNNNCCGAA AAACACUA | 5670 |
| 79 | GUGUUUCUC UUGAUCUG | 1515 | CAGAUCAA CUGAUGAGgNNNNNNNNCCGAA AGAAACAC | 5671 |
| 81 | GUUUCUCUU GAUCUGCC | 1516 | GGCAGAUC CUGAUGAGgNNNNNNNNCCGAA AGAGAAAC | 5672 |
| 85 | CUCUUGAUC UGCCCAGG | 1517 | CCUGGGCA CUGAUGAGgNNNNNNNNCCGAA AUCAAGAG | 5673 |
| 96 | CCCAGGCUC AGCAUACA | 1518 | UGUAUGCU CUGAUGAGgNNNNNNNNCCGAA AGCCUGGG | 5674 |
| 102 | CUCAGCAUA CAAAAAGA | 1519 | UCUUUUUG CUGAUGAGgNNNNNNNNCCGAA AUGCUGAG | 5675 |
| 114 | AAAGACAUA CUUACAAU | 1520 | AUUGUAAG CUGAUGAGgNNNNNNNNCCGAA AUGUCUUU | 5676 |
| 117 | GACAUACUU ACAAUUAA | 1521 | UUAAUUGU CUGAUGAGgNNNNNNNNCCGAA AGUAUGUC | 5677 |
| 118 | ACAUACUUA CAAUUAAG | 1522 | CUUAAUUG CUGAUGAGgNNNNNNNNCCGAA AAGUAUGU | 5678 |
| 123 | CUUACAAUU AAGGCUAA | 1523 | UUAGCCUU CUGAUGAGgNNNNNNNNCCGAA AUUGUAAG | 5679 |
| 124 | UUACAAUUA AGGCUAAU | 1524 | AUUAGCCU CUGAUGAGgNNNNNNNNCCGAA AAUUGUAA | 5680 |
| 130 | UUAAGGCUA AUACAACU | 1525 | AGUUGUAU CUGAUGAGgNNNNNNNNCCGAA AGCCUUAA | 5681 |
| 133 | AGGCUAAUA CAACUCUU | 1526 | AAGAGUUG CUGAUGAGgNNNNNNNNCCGAA AUUAGCCU | 5682 |
| 139 | AUACAACUC UUCAAAUU | 1527 | AAUUUGAA CUGAUGAGgNNNNNNNNCCGAA AGUUGUAU | 5683 |
| 141 | ACAACUCUU CAAAUUAC | 1528 | GUAAUUUG CUGAUGAGgNNNNNNNNCCGAA AGAGUUGU | 5684 |
| 142 | CAACUCUUC AAAUUACU | 1529 | AGUAAUUU CUGAUGAGgNNNNNNNNCCGAA AAGAGUUG | 5685 |
| 147 | CUUCAAAUU ACUUGCAG | 1530 | CUGCAAGU CUGAUGAGgNNNNNNNNCCGAA AUUUGAAG | 5686 |
| 148 | UUCAAAUUA CUUGCAGG | 1531 | CCUGCAAG CUGAUGAGgNNNNNNNNCCGAA AAUUUGAA | 5687 |
| 151 | AAAUUACUU GCAGGGGA | 1532 | UCCCCUGC CUGAUGAGgNNNNNNNNCCGAA AGUAAUUU | 5688 |
| 170 | GAGGGACUU GGACUGGC | 1533 | GCCAGUCC CUGAUGAGgNNNNNNNNCCGAA AGUCCCUC | 5689 |
| 180 | GACUGGCUU UGGCCCAA | 1534 | UUGGGCCA CUGAUGAGgNNNNNNNNCCGAA AGCCAGUC | 5690 |
| 181 | ACUGGCUUU GGCCCAAU | 1535 | AUUGGGCC CUGAUGAGgNNNNNNNNCCGAA AAGCCAGU | 5691 |
| 190 | GGCCCAAUA UCAGAGUG | 1536 | ACUCUGAU CUGAUGAGgNNNNNNNNCCGAA AUUGGGCC | 5692 |
| 193 | CCAAUAAUC AGAGUGGC | 1537 | GCCACUCU CUGAUGAGgNNNNNNNNCCGAA AUUAUUGG | 5693 |
| 243 | GAUGGCCUC UUCUGUAA | 1538 | UUACAGAA CUGAUGAGgNNNNNNNNCCGAA AGGCCAUC | 5694 |
| 245 | UGGCCUCUU CUGUAAGA | 1539 | UCUUACAG CUGAUGAGgNNNNNNNNCCGAA AGAGGCCA | 5695 |
| 246 | GGCCUCUUC UGUAAGAC | 1540 | GUCUUACA CUGAUGAGgNNNNNNNNCCGAA AAGAGGCC | 5696 |
| 250 | UCUUCUGUA AGACACUC | 1541 | GAGUGUCU CUGAUGAGgNNNNNNNNCCGAA AACAGAAGA | 5697 |
| 258 | AAGACACUC ACAAUUCC | 1542 | GGAAUUGU CUGAUGAGgNNNNNNNNCCGAA AGUGUCUU | 5698 |
| 264 | CUCACAAUU CCAAAAGU | 1543 | ACUUUUGG CUGAUGAGgNNNNNNNNCCGAA AUUGUGAG | 5699 |
| 265 | UCACAAUUC CAAAAGUG | 1544 | CACUUUUG CUGAUGAGgNNNNNNNNCCGAA AAUUGUGA | 5700 |
| 276 | AAAGUGAUC GGAAAUGA | 1545 | UCAUUUCC CUGAUGAGgNNNNNNNNCCGAA AUCACUUU | 5701 |
| 296 | UGGAGCCUA CAAGUGCU | 1546 | AGCACUUG CUGAUGAGgNNNNNNNNCCGAA AGGCUCCA | 5702 |
| 305 | CAAGUGCUU CUACCGGG | 1547 | CCCGGUAG CUGAUGAGgNNNNNNNNCCGAA AGCACUUG | 5703 |
| 306 | AAGUGCUUC UACCGGGA | 1548 | UCCCGGUA CUGAUGAGgNNNNNNNNCCGAA AAGCACUU | 5704 |
| 308 | GUGCUUCUA CCGGGAAA | 1549 | UUUCCCGG CUGAUGAGgNNNNNNNNCCGAA AGAAGCAC | 5705 |
| 323 | AACUGACUU GGCCUCGG | 1550 | CCGAGGCC CUGAUGAGgNNNNNNNNCCGAA AGUCAGUU | 5706 |
| 329 | CUUGGCCUC GGUCAUUU | 1551 | AAAUGACC CUGAUGAGgNNNNNNNNCCGAA AGGCCAAG | 5707 |
| 333 | GCCUCGGUC AUUUAUGU | 1552 | ACAUAAAU CUGAUGAGgNNNNNNNNCCGAA ACCGAGGC | 5708 |
| 336 | UCGGUCAUU UAUGUCUA | 1553 | UAGACAUA CUGAUGAGgNNNNNNNNCCGAA AUGACCGA | 5709 |
| 337 | CGGUCAUUU AUGUCUAU | 1554 | AUAGACAU CUGAUGAGgNNNNNNNNCCGAA AAUGACCG | 5710 |
| 338 | GGUCAUUUA UGUCUAUG | 1555 | CAUAGACA CUGAUGAGgNNNNNNNNCCGAA AAAUGACC | 5711 |
| 342 | AUUUAUGUC UAUGUUCA | 1556 | UGAACAUA CUGAUGAGgNNNNNNNNCCGAA ACAUAAAU | 5712 |
| 344 | UUAUGUCUA UGUUCAAG | 1557 | CUUGAACA CUGAUGAGgNNNNNNNNCCGAA AGACAUAA | 5713 |
| 348 | GUCUAUGUU CAAGAUUA | 1558 | UAAUCUUG CUGAUGAGgNNNNNNNNCCGAA ACAUAGAC | 5714 |

TABLE IV-continued

Human KDR VEGF Receptor-Hammerhead Ribozyme and Substrate Sequence

| Pos | Substrate | Seq ID No | HH Ribozyme Sequence | Seq ID No |
|-----|-----------|-----------|----------------------|-----------|
| 349 | UCUAUGUUC AAGAUUAC | 1559 | GUAAUCUU CUGAUGAGGNNNNNNNNCCGAA AACAUAGA | 5715 |
| 355 | UUCAAGAUU ACAGAUCU | 1560 | AGAUCUGU CUGAUGAGGNNNNNNNNCCGAA AUCUUGAA | 5716 |
| 356 | UCAAGAUUA CAGAUCUC | 1561 | GAGAUCUG CUGAUGAGGNNNNNNNNCCGAA AAUCUUGA | 5717 |
| 362 | UUACAGAUC UCCAUUUA | 1562 | UAAAUGGA CUGAUGAGGNNNNNNNNCCGAA AUCUGUAA | 5718 |
| 364 | ACAGAUCUC CAUUUAUU | 1563 | AAUAAAUG CUGAUGAGGNNNNNNNNCCGAA AGAUCUGU | 5719 |
| 368 | AUCUCCAUU UAUUGCUU | 1564 | AAGCAAUA CUGAUGAGGNNNNNNNNCCGAA AUGGAGAU | 5720 |
| 369 | UCUCCAUUU AUUGCUUC | 1565 | GAAGCAAU CUGAUGAGGNNNNNNNNCCGAA AAUGGAGA | 5721 |
| 370 | CUCCAUUUA UUGCUUCU | 1566 | AGAAGCAA CUGAUGAGGNNNNNNNNCCGAA AAAUGGAG | 5722 |
| 372 | CCAUUUAUU GCUUCUGU | 1567 | ACAGAAGC CUGAUGAGGNNNNNNNNCCGAA AUAAAUGG | 5723 |
| 376 | UUAUUGCUU CUGUUAGU | 1568 | ACUAACAG CUGAUGAGGNNNNNNNNCCGAA AGCAAUAA | 5724 |
| 377 | UAUUGCUUC UGUUAGUG | 1569 | CACUAACA CUGAUGAGGNNNNNNNNCCGAA AAGCAAUA | 5725 |
| 381 | GCUUCUGUU AGUGACCA | 1570 | UGGUCACU CUGAUGAGGNNNNNNNNCCGAA ACAGAAGC | 5726 |
| 382 | CUUCUGUUA GUGACCAA | 1571 | UUGGUCAC CUGAUGAGGNNNNNNNNCCGAA AACAGAAG | 5727 |
| 399 | CAUGGAGUC GUGUACAU | 1572 | AUGUACAC CUGAUGAGGNNNNNNNNCCGAA ACUCCAUG | 5728 |
| 404 | AGUCGUGUA CAUUACUG | 1573 | CAGUAAUG CUGAUGAGGNNNNNNNNCCGAA ACACGACU | 5729 |
| 408 | GUGUACAUU ACUGAGAA | 1574 | UUCUCAGU CUGAUGAGGNNNNNNNNCCGAA AUGUACAC | 5730 |
| 409 | UGUACAUUA CUGAGAAC | 1575 | GUUCUCAG CUGAUGAGGNNNNNNNNCCGAA AAUGUACA | 5731 |
| 438 | GUGGUGAUU CCAUGUCU | 1576 | AGACAUGG CUGAUGAGGNNNNNNNNCCGAA AUCACCAC | 5732 |
| 439 | UGGUGAUUC CAUGUCUC | 1577 | GAGACAUG CUGAUGAGGNNNNNNNNCCGAA AAUCACCA | 5733 |
| 445 | UUCCAUGUC UCGGGUCC | 1578 | GGACCCGA CUGAUGAGGNNNNNNNNCCGAA ACAUGGAA | 5734 |
| 447 | CCAUGUCUC GGGUCCAU | 1579 | AUGGACCC CUGAUGAGGNNNNNNNNCCGAA AGACAUGG | 5735 |
| 452 | UCUCGGGUC CAUUUCAA | 1580 | UUGAAAUG CUGAUGAGGNNNNNNNNCCGAA ACCCGAGA | 5736 |
| 456 | GGGUCCAUU UCAAAUCU | 1581 | AGAUUUGA CUGAUGAGGNNNNNNNNCCGAA AUGGACCC | 5737 |
| 457 | GGUCCAUUU CAAAUCUC | 1582 | GAGAUUUG CUGAUGAGGNNNNNNNNCCGAA AAUGGACC | 5738 |
| 458 | GUCCAUUUC AAAUCUCA | 1583 | UGAGAUUU CUGAUGAGGNNNNNNNNCCGAA AAAUGGAC | 5739 |
| 463 | UUUCAAAUC UCAACGUG | 1584 | CACGUUGA CUGAUGAGGNNNNNNNNCCGAA AUUUGAAA | 5740 |
| 465 | UCAAAUCUC AACGUGUC | 1585 | GACACGUU CUGAUGAGGNNNNNNNNCCGAA AGAUUUGA | 5741 |
| 473 | CAACGUGUC ACUUUGUG | 1586 | CACAAAGU CUGAUGAGGNNNNNNNNCCGAA ACACGUUG | 5742 |
| 477 | GUGUCACUU UGUGCAAG | 1587 | CUUGCACA CUGAUGAGGNNNNNNNNCCGAA AGUGACAC | 5743 |
| 478 | UGUCACUUU GUGCAAGA | 1588 | UCUUGCAC CUGAUGAGGNNNNNNNNCCGAA AAGUGACA | 5744 |
| 488 | UGCAAGAUA CCCAGAAA | 1589 | UUUCUGGG CUGAUGAGGNNNNNNNNCCGAA AUCUUGCA | 5745 |
| 503 | AAAGAGAUU UGUUCCUG | 1590 | CAGGAACA CUGAUGAGGNNNNNNNNCCGAA AUCUCUUU | 5746 |
| 504 | AAGAGAUUU GUUCCUGA | 1591 | UCAGGAAC CUGAUGAGGNNNNNNNNCCGAA AAUCUCUU | 5747 |
| 507 | AGAUUUGUU CCUGAUGG | 1592 | CCAUCAGG CUGAUGAGGNNNNNNNNCCGAA ACAAAUCU | 5748 |
| 508 | GAUUUGUUC CUGAUGGU | 1593 | ACCAUCAG CUGAUGAGGNNNNNNNNCCGAA AACAAAUC | 5749 |
| 517 | CUGAUGGUA ACAGAAUU | 1594 | AAUUCUGU CUGAUGAGGNNNNNNNNCCGAA ACCAUCAG | 5750 |
| 525 | AACAGAAUU UCCUGGGA | 1595 | UCCCAGGA CUGAUGAGGNNNNNNNNCCGAA AUUCUGUU | 5751 |
| 526 | ACAGAAUUU CCUGGGAC | 1596 | GUCCCAGG CUGAUGAGGNNNNNNNNCCGAA AAUUCUGU | 5752 |
| 527 | CAGAAUUUC CUGGGACA | 1597 | UGUCCCAG CUGAUGAGGNNNNNNNNCCGAA AAAUUCUG | 5753 |
| 548 | GAAGGGCUU UACUAUUC | 1598 | GAAUAGUA CUGAUGAGGNNNNNNNNCCGAA AGCCCUUC | 5754 |
| 549 | AAGGGCUUU ACUAUUCC | 1599 | GGAAUAGU CUGAUGAGGNNNNNNNNCCGAA AAGCCCUU | 5755 |
| 550 | AGGGCUUUA CUAUUCCC | 1600 | GGGAAUAG CUGAUGAGGNNNNNNNNCCGAA AAAGCCCU | 5756 |
| 553 | GCUUUACUA UUCCCAGC | 1601 | GCUGGGAA CUGAUGAGGNNNNNNNNCCGAA AGUAAAGC | 5757 |
| 555 | UUUACUAUU CCCAGCUA | 1602 | UAGCUGGG CUGAUGAGGNNNNNNNNCCGAA AUAGUAAA | 5758 |
| 556 | UUACUAUUC CCAGCUAC | 1603 | GUAGCUGG CUGAUGAGGNNNNNNNNCCGAA AAUAGUAA | 5759 |
| 563 | UCCCAGCUA CAUGAUCA | 1604 | UGAUCAUG CUGAUGAGGNNNNNNNNCCGAA AGCUGGGA | 5760 |
| 570 | UACAUGAUC AGCUAUGC | 1605 | GCAUAGCU CUGAUGAGGNNNNNNNNCCGAA AUCAUGUA | 5761 |
| 575 | GAUCAGCUA UGCUGGCA | 1606 | UGCCAGCA CUGAUGAGGNNNNNNNNCCGAA AGCUGAUC | 5762 |
| 588 | GGCAUGGUC UUCUGUGA | 1607 | UCACAGAA CUGAUGAGGNNNNNNNNCCGAA ACCAUGCC | 5763 |
| 590 | CAUGGUCUU CUGUGAAG | 1608 | CUUCACAG CUGAUGAGGNNNNNNNNCCGAA AGACCAUG | 5764 |
| 591 | AUGGUCUUC UGUGAAGC | 1609 | GCUUCACA CUGAUGAGGNNNNNNNNCCGAA AAGACCAU | 5765 |
| 606 | GCAAAAAUU AAUGAUGA | 1610 | UCAUCAUU CUGAUGAGGNNNNNNNNCCGAA AUUUUUGC | 5766 |
| 607 | CAAAAAUUA AUGAUGAA | 1611 | UUCAUCAU CUGAUGAGGNNNNNNNNCCGAA AAUUUUUG | 5767 |
| 619 | AUGAAAGUU ACCAGUCU | 1612 | AGACUGGU CUGAUGAGGNNNNNNNNCCGAA ACUUUCAU | 5768 |
| 620 | UGAAAGUUA CCAGUCUA | 1613 | UAGACUGG CUGAUGAGGNNNNNNNNCCGAA AACUUUCA | 5769 |
| 626 | UUACCAGUC UAUUAUGU | 1614 | ACAUAAUA CUGAUGAGGNNNNNNNNCCGAA ACUGGUAA | 5770 |
| 628 | ACCAGUCUA UUAUGUAC | 1615 | GUACAUAA CUGAUGAGGNNNNNNNNCCGAA AGACUGGU | 5771 |
| 630 | CAGUCUAUU AUGUACAU | 1616 | AUGUACAU CUGAUGAGGNNNNNNNNCCGAA AUAGACUG | 5772 |
| 631 | AGUCUAUUA UGUACAUA | 1617 | UAUGUACA CUGAUGAGGNNNNNNNNCCGAA AAUAGACU | 5773 |
| 635 | UAUUAUGUA CAUAGUUG | 1618 | CAACUAUG CUGAUGAGGNNNNNNNNCCGAA ACAUAAUA | 5774 |
| 639 | AUGUACAUA GUUGUCGU | 1619 | ACGACAAC CUGAUGAGGNNNNNNNNCCGAA AUGUACAU | 5775 |
| 642 | UACAUAGUU GUCGUUGU | 1620 | ACAACGAC CUGAUGAGGNNNNNNNNCCGAA ACUAUGUA | 5776 |
| 645 | AUAGUUGUC GUUGUAGG | 1621 | CCUACAAC CUGAUGAGGNNNNNNNNCCGAA ACAACUAU | 5777 |
| 648 | GUUGUCGUU GUAGGGUA | 1622 | UACCCUAC CUGAUGAGGNNNNNNNNCCGAA ACGACAAC | 5778 |
| 651 | GUCGUUGUA GGGUAUAG | 1623 | CUAUACCC CUGAUGAGGNNNNNNNNCCGAA ACAACGAC | 5779 |
| 656 | UGUAGGGUA UAGGAUUU | 1624 | AAAUCCUA CUGAUGAGGNNNNNNNNCCGAA ACCCUACA | 5780 |
| 658 | UAGGGUAUA GGAUUUAU | 1625 | AUAAAUCC CUGAUGAGGNNNNNNNNCCGAA AUACCCUA | 5781 |
| 663 | UAUAGGAUU UAUGAUGU | 1626 | ACAUCAUA CUGAUGAGGNNNNNNNNCCGAA AUCCUAUA | 5782 |
| 664 | AUAGGAUUU AUGAUGUG | 1627 | CACAUCAU CUGAUGAGGNNNNNNNNCCGAA AAUCCUAU | 5783 |
| 665 | UAGGAUUUA UGAUGUGG | 1628 | CCACAUCA CUGAUGAGGNNNNNNNNCCGAA AAAUCCUA | 5784 |
| 675 | GAUGUGGUU CUGAGUCC | 1629 | GGACUCAG CUGAUGAGGNNNNNNNNCCGAA ACCACAUC | 5785 |
| 676 | AUGUGGUUC UGAGUCCG | 1630 | CGGACUCA CUGAUGAGGNNNNNNNNCCGAA AACCACAU | 5786 |
| 682 | UUCUGAGUC CGUCUCAU | 1631 | AUGAGACG CUGAUGAGGNNNNNNNNCCGAA ACUCAGAA | 5787 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 686 | GAGUCCGUC UCAUGGAA | 1632 | UUCCAUGA CUGAUGAGGNNNNNNNNCCGAA ACGGACUC | 5788 |
| 688 | GUCCGUCUC AUGGAAUU | 1633 | AAUUCCAU CUGAUGAGGNNNNNNNNCCGAA AGACGGAC | 5789 |
| 696 | CAUGGAAUU GAACUAUC | 1634 | GAUAGUUC CUGAUGAGGNNNNNNNNCCGAA AUUCCAUG | 5790 |
| 702 | AUUGAACUA UCUGUUGG | 1635 | CCAACAGA CUGAUGAGGNNNNNNNNCCGAA AGUUCAAU | 5791 |
| 704 | UGAACUAUC UGUUGGAG | 1636 | CUCCAACA CUGAUGAGGNNNNNNNNCCGAA AUAGUUCA | 5792 |
| 708 | CUAUCUGUU GGAGAAAA | 1637 | UUUUCUCC CUGAUGAGGNNNNNNNNCCGAA ACAGAUAG | 5793 |
| 720 | GAAAAGCUU GUCUUAAA | 1638 | UUUAAGAC CUGAUGAGGNNNNNNNNCCGAA AGCUUUUC | 5794 |
| 723 | AAGCUUGUC UUAAAUUG | 1639 | CAAUUUAA CUGAUGAGGNNNNNNNNCCGAA ACAAGCUU | 5795 |
| 725 | GCUUGUCUU AAAUUGUA | 1640 | UACAAUUU CUGAUGAGGNNNNNNNNCCGAA AGACAAGC | 5796 |
| 726 | CUUGUCUUA AAUUGUAC | 1641 | GUACAAUU CUGAUGAGGNNNNNNNNCCGAA AAGACAAG | 5797 |
| 730 | UCUUAAAUU GUACAGCA | 1642 | UGCUGUAC CUGAUGAGGNNNNNNNNCCGAA AUUUAAGA | 5798 |
| 733 | UAAAUUGUA CAGCAAGA | 1643 | UCUUGCUG CUGAUGAGGNNNNNNNNCCGAA ACAAUUUA | 5799 |
| 750 | ACUGAACUA AAUGUGGG | 1644 | CCCACAUU CUGAUGAGGNNNNNNNNCCGAA AGUUCAGU | 5800 |
| 762 | GUGGGGAUU GACUUCAA | 1645 | UUGAAGUC CUGAUGAGGNNNNNNNNCCGAA AUCCCCAC | 5801 |
| 767 | GAUUGACUU CAACUGGG | 1646 | CCCAGUUG CUGAUGAGGNNNNNNNNCCGAA AGUCAAUC | 5802 |
| 768 | AUUGACUUC AACUGGGA | 1647 | UCCCAGUU CUGAUGAGGNNNNNNNNCCGAA AAGUCAAU | 5803 |
| 779 | CUGGGAAUA CCCUUCUU | 1648 | AAGAAGGG CUGAUGAGGNNNNNNNNCCGAA AUUCCCAG | 5804 |
| 784 | AAUACCCUU CUUCGAAG | 1649 | CUUCGAAG CUGAUGAGGNNNNNNNNCCGAA AGGGUAUU | 5805 |
| 785 | AUACCCUUC UUCGAAGC | 1650 | GCUUCGAA CUGAUGAGGNNNNNNNNCCGAA AAGGGUAU | 5806 |
| 787 | ACCCUUCUU CGAAGCAU | 1651 | AUGCUUCG CUGAUGAGGNNNNNNNNCCGAA AGAAGGGU | 5807 |
| 788 | CCCUUCUUC GAAGCAUC | 1652 | GAUGCUUC CUGAUGAGGNNNNNNNNCCGAA AAGAAGGG | 5808 |
| 796 | CGAAGCAUC AGCAUAAG | 1653 | CUUAUGCU CUGAUGAGGNNNNNNNNCCGAA AUGCUUCG | 5809 |
| 802 | AUCAGCAUA AGAAACUU | 1654 | AAGUUUCU CUGAUGAGGNNNNNNNNCCGAA AUGCUGAU | 5810 |
| 810 | AAGAAACUU GUAAACCG | 1655 | CGGUUUAC CUGAUGAGGNNNNNNNNCCGAA AGUUUCUU | 5811 |
| 813 | AAACUUGUA AACCGAGA | 1656 | UCUCGGUU CUGAUGAGGNNNNNNNNCCGAA ACAAGUUU | 5812 |
| 825 | CGAGACCUA AAAACCCA | 1657 | UGGGUUUU CUGAUGAGGNNNNNNNNCCGAA AGGUCUCG | 5813 |
| 836 | AACCCAGUC UGGGAGUG | 1658 | CACUCCCA CUGAUGAGGNNNNNNNNCCGAA ACUGGGUU | 5814 |
| 857 | GAAGAAAUU UUUGAGCA | 1659 | UGCUCAAA CUGAUGAGGNNNNNNNNCCGAA AUUUCUUC | 5815 |
| 858 | AAGAAAUUU UUGAGCAC | 1660 | GUGCUCAA CUGAUGAGGNNNNNNNNCCGAA AAUUUCUU | 5816 |
| 859 | AGAAAUUUU UGAGCACC | 1661 | GGUGCUCA CUGAUGAGGNNNNNNNNCCGAA AAAUUUCU | 5817 |
| 860 | GAAAUUUUU GAGCACCU | 1662 | AGGUGCUC CUGAUGAGGNNNNNNNNCCGAA AAAAUUUC | 5818 |
| 869 | GAGCACCUU AACUAUAG | 1663 | CUAUAGUU CUGAUGAGGNNNNNNNNCCGAA AGGUGCUC | 5819 |
| 870 | AGCACCUUA ACUAUAGA | 1664 | UCUAUAGU CUGAUGAGGNNNNNNNNCCGAA AAGGUGCU | 5820 |
| 874 | CCUUAACUA UAGAUGGU | 1665 | ACCAUCUA CUGAUGAGGNNNNNNNNCCGAA AGUUAAGG | 5821 |
| 876 | UUAACUAUA GAUGGUGU | 1666 | ACACCAUC CUGAUGAGGNNNNNNNNCCGAA AUAGUUAA | 5822 |
| 885 | GAUGGUGUA ACCCGGAG | 1667 | CUCCGGGU CUGAUGAGGNNNNNNNNCCGAA ACACCAUC | 5823 |
| 905 | CCAAGGAUU GUACACCU | 1668 | AGGUGUAC CUGAUGAGGNNNNNNNNCCGAA AUCCUUGG | 5824 |
| 908 | AGGAUUGUA CACCUGUG | 1669 | CACAGGUG CUGAUGAGGNNNNNNNNCCGAA ACAAUCCU | 5825 |
| 923 | UGCAGCAUC CAGUGGGC | 1670 | GCCCACUG CUGAUGAGGNNNNNNNNCCGAA AUGCUGCA | 5826 |
| 956 | CAGCACAUU UGUCAGGG | 1671 | CCCUGACA CUGAUGAGGNNNNNNNNCCGAA AUGUGCUG | 5827 |
| 957 | AGCACAUUU GUCAGGGU | 1672 | ACCCUGAC CUGAUGAGGNNNNNNNNCCGAA AAUGUGCU | 5828 |
| 960 | ACAUUUGUC AGGGUCCA | 1673 | UGGACCCU CUGAUGAGGNNNNNNNNCCGAA ACAAAUGU | 5829 |
| 966 | GUCAGGGUC CAUGAAAA | 1674 | UUUUCAUG CUGAUGAGGNNNNNNNNCCGAA ACCCUGAC | 5830 |
| 979 | AAAAACCUU UUGUUGCU | 1675 | AGCAACAA CUGAUGAGGNNNNNNNNCCGAA AGGUUUUU | 5831 |
| 980 | AAAACCUUU UGUUGCUU | 1676 | AAGCAACA CUGAUGAGGNNNNNNNNCCGAA AAGGUUUU | 5832 |
| 981 | AAACCUUUU GUUGCUUU | 1677 | AAAGCAAC CUGAUGAGGNNNNNNNNCCGAA AAAGGUUU | 5833 |
| 984 | CCUUUUGUU GCUUUUGG | 1678 | CCAAAAGC CUGAUGAGGNNNNNNNNCCGAA ACAAAAGG | 5834 |
| 988 | UUGUUGCUU UUGGAAGU | 1679 | ACUUCCAA CUGAUGAGGNNNNNNNNCCGAA AGCAACAA | 5835 |
| 989 | UGUUGCUUU UGGAAGUG | 1680 | CACUUCCA CUGAUGAGGNNNNNNNNCCGAA AAGCAACA | 5836 |
| 990 | GUUGCUUUU GGAAGUGG | 1681 | CCACUUCC CUGAUGAGGNNNNNNNNCCGAA AAAGCAAC | 5837 |
| 1007 | CAUGGAAUC UCUGGUGG | 1682 | CCACCAGA CUGAUGAGGNNNNNNNNCCGAA AUUCCAUG | 5838 |
| 1009 | UGGAAUCUC UGGUGGAA | 1683 | UUCCACCA CUGAUGAGGNNNNNNNNCCGAA AGAUUCCA | 5839 |
| 1038 | GAGCGUGUC AGAAUCCC | 1684 | GGGAUUCU CUGAUGAGGNNNNNNNNCCGAA ACACGCUC | 5840 |
| 1044 | GUCAGAAUC CCUGCGAA | 1685 | UUCGCAGG CUGAUGAGGNNNNNNNNCCGAA AUUCUGAC | 5841 |
| 1055 | UGCGAAGUA CCUUGGUU | 1686 | AACCAAGG CUGAUGAGGNNNNNNNNCCGAA ACUUCGCA | 5842 |
| 1059 | AAGUACCUU GGUUACCC | 1687 | GGGUAACC CUGAUGAGGNNNNNNNNCCGAA AGGUACUU | 5843 |
| 1063 | ACCUUGGUU ACCCACCC | 1688 | GGGUGGGU CUGAUGAGGNNNNNNNNCCGAA ACCAAGGU | 5844 |
| 1064 | CCUUGGUUA CCCACCCC | 1689 | GGGGUGGG CUGAUGAGGNNNNNNNNCCGAA AACCAAGG | 5845 |
| 1080 | CCAGAAAUA AAAUGGUA | 1690 | UACCAUUU CUGAUGAGGNNNNNNNNCCGAA AUUUCUGG | 5846 |
| 1088 | AAAAUGGUA UAAAAAUG | 1691 | CAUUUUUA CUGAUGAGGNNNNNNNNCCGAA ACCAUUUU | 5847 |
| 1090 | AAUGGUAUA AAAAUGGA | 1692 | UCCAUUUU CUGAUGAGGNNNNNNNNCCGAA AUACCAUU | 5848 |
| 1101 | AAUGGAAUA CCCCUUGA | 1693 | UCAAGGGG CUGAUGAGGNNNNNNNNCCGAA AUUCCAUU | 5849 |
| 1107 | AUACCCCUU GAGUCCAA | 1694 | UUGGACUC CUGAUGAGGNNNNNNNNCCGAA AGGGGUAU | 5850 |
| 1112 | CCUUGAGUC CAAUCACA | 1695 | UGUGAUUG CUGAUGAGGNNNNNNNNCCGAA ACUCAAGG | 5851 |
| 1117 | AGUCCAAUC ACACAAUU | 1696 | AAUUGUGU CUGAUGAGGNNNNNNNNCCGAA AUUGGACU | 5852 |
| 1125 | CACACAAUU AAAGCGGG | 1697 | CCCGCUUU CUGAUGAGGNNNNNNNNCCGAA AUUGUGUG | 5853 |
| 1126 | ACACAAUUA AAGCGGGC | 1698 | CCCCGCUU CUGAUGAGGNNNNNNNNCCGAA AAUUGUGU | 5854 |
| 1140 | GGGCAUGUA CUGACGAU | 1699 | AUCGUCAG CUGAUGAGGNNNNNNNNCCGAA ACAUGCCC | 5855 |
| 1149 | CUGACGAUU AUGGAAGU | 1700 | ACUUCCAU CUGAUGAGGNNNNNNNNCCGAA AUCGUCAG | 5856 |
| 1150 | UGACGAUUA UGGAAGUG | 1701 | CACUUCCA CUGAUGAGGNNNNNNNNCCGAA AAUCGUCA | 5857 |
| 1180 | CAGGAAAUU ACACUGUC | 1702 | GACAGUGU CUGAUGAGGNNNNNNNNCCGAA AUUUCCUG | 5858 |
| 1181 | AGGAAAUUA CACUGUCA | 1703 | UGACAGUG CUGAUGAGGNNNNNNNNCCGAA AAUUUCCU | 5859 |
| 1188 | UACACUGUC AUCCUUAC | 1704 | GUAAGGAU CUGAUGAGGNNNNNNNNCCGAA ACAGUGUA | 5860 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1191 | ACUGUCAUC CUUACCAA | 1705 | UUGGUAAG CUGAUGAGGNNNNNNNNCCGAA AUGACAGU | 5861 |
| 1194 | GUCAUCCUU ACCAAUCC | 1706 | GGAUUGGU CUGAUGAGGNNNNNNNNCCGAA AGGAUGAC | 5862 |
| 1195 | UCAUCCUUA CCAAUCCC | 1707 | GGGAUUGG CUGAUGAGGNNNNNNNNCCGAA AAGGAUGA | 5863 |
| 1201 | UUACCAAUC CCAUUUCA | 1708 | UGAAAUGG CUGAUGAGGNNNNNNNNCCGAA AUUGGUAA | 5864 |
| 1206 | AAUCCCAUU UCAAAGGA | 1709 | UCCUUUGA CUGAUGAGGNNNNNNNNCCGAA AUGGGAUU | 5865 |
| 1207 | AUCCCAUUU CAAAGGAG | 1710 | CUCCUUUG CUGAUGAGGNNNNNNNNCCGAA AUGGGAU | 5866 |
| 1208 | UCCCAUUUC AAAGGAGA | 1711 | UCUCCUUU CUGAUGAGGNNNNNNNNCCGAA AAAUGGGA | 5867 |
| 1233 | CAUGUGGUC UCUCUGGU | 1712 | ACCAGAGA CUGAUGAGGNNNNNNNNCCGAA ACCACAUG | 5868 |
| 1235 | UGUGGUCUC UCUGGUUG | 1713 | CAACCAGA CUGAUGAGGNNNNNNNNCCGAA AGACCACA | 5869 |
| 1237 | UGGUCUCUC UGGUUGUG | 1714 | CACAACCA CUGAUGAGGNNNNNNNNCCGAA AGAGACCA | 5870 |
| 1242 | UCUCUGGUU GUGUAUGU | 1715 | ACAUACAC CUGAUGAGGNNNNNNNNCCGAA ACCAGAGA | 5871 |
| 1247 | GGUUGUGUA UGUCCCAC | 1716 | GUGGGACA CUGAUGAGGNNNNNNNNCCGAA ACACAACC | 5872 |
| 1251 | GUGUAUGUC CCACCCCA | 1717 | UGGGGUGG CUGAUGAGGNNNNNNNNCCGAA ACAUACAC | 5873 |
| 1263 | CCCCAGAUU GGUGAGAA | 1718 | UUCUCACC CUGAUGAGGNNNNNNNNCCGAA AUCUGGGG | 5874 |
| 1274 | UGAGAAAUC UCUAAUCU | 1719 | AGAUUAGA CUGAUGAGGNNNNNNNNCCGAA AUUUCUCA | 5875 |
| 1275 | AGAAAUCUC UAAUCUCU | 1720 | AGAGAUUA CUGAUGAGGNNNNNNNNCCGAA AGAUUUCU | 5876 |
| 1278 | AAAUCUCUA AUCUCUCC | 1721 | GGAGAGAU CUGAUGAGGNNNNNNNNCCGAA AGAGAUUU | 5877 |
| 1281 | UCUCUAAUC UCUCCUGU | 1722 | ACAGGAGA CUGAUGAGGNNNNNNNNCCGAA AUUAGAGA | 5878 |
| 1283 | UCUAAUCUC UCCUGUGG | 1723 | CCACAGGA CUGAUGAGGNNNNNNNNCCGAA AGAUUAGA | 5879 |
| 1285 | UAAUCUCUC CUGUGGAU | 1724 | AUCCACAG CUGAUGAGGNNNNNNNNCCGAA AGAGAUUA | 5880 |
| 1294 | CUGUGGAUU CCUACCAG | 1725 | CUGGUAGG CUGAUGAGGNNNNNNNNCCGAA AUCCACAG | 5881 |
| 1295 | UGUGGAUUC CUACCAGU | 1726 | ACUGGUAG CUGAUGAGGNNNNNNNNCCGAA AAUCCACA | 5882 |
| 1298 | GGAUUCCUA CCAGUACG | 1727 | CGUACUGG CUGAUGAGGNNNNNNNNCCGAA AGGAAUCC | 5883 |
| 1304 | CUACCAGUA CGGCACCA | 1728 | UGGUGCCG CUGAUGAGGNNNNNNNNCCGAA ACUGGUAG | 5884 |
| 1315 | GCACCACUC AAACGCUG | 1729 | CAGCGUUU CUGAUGAGGNNNNNNNNCCGAA AGUGGUGC | 5885 |
| 1330 | UGACAUGUA CGGUCUAU | 1730 | AUAGACCG CUGAUGAGGNNNNNNNNCCGAA ACAUGUCA | 5886 |
| 1335 | UGUACGGUC UAUGCCAU | 1731 | AUGGCAUA CUGAUGAGGNNNNNNNNCCGAA ACCGUACA | 5887 |
| 1337 | UACGGUCUA UGCCAUUC | 1732 | GAAUGGCA CUGAUGAGGNNNNNNNNCCGAA AGACCGUA | 5888 |
| 1344 | UAUGCCAUU CCUCCCCC | 1733 | GGGGGAGG CUGAUGAGGNNNNNNNNCCGAA AUGGCAUA | 5889 |
| 1345 | AUGCCAUUC CUCCCCCG | 1734 | CGGGGGAG CUGAUGAGGNNNNNNNNCCGAA AAUGGCAU | 5890 |
| 1348 | CCAUUCCUC CCCGCAU | 1735 | AUGCGGGG CUGAUGAGGNNNNNNNNCCGAA AGGAAUGG | 5891 |
| 1357 | CCCCGCAUC ACAUCCAC | 1736 | GUGGAUGU CUGAUGAGGNNNNNNNNCCGAA AUGCGGGG | 5892 |
| 1362 | CAUCACAUC CACUGGUA | 1737 | UACCAGUG CUGAUGAGGNNNNNNNNCCGAA AUGUGAUG | 5893 |
| 1370 | CCACUGGUA UUGGCAGU | 1738 | ACUGCCAA CUGAUGAGGNNNNNNNNCCGAA ACCAGUGG | 5894 |
| 1372 | ACUGGUAUU GGCAGUUG | 1739 | CAACUGCC CUGAUGAGGNNNNNNNNCCGAA AUACCAGU | 5895 |
| 1379 | UUGGCAGUU GGAGGAAG | 1740 | CUUCCUCC CUGAUGAGGNNNNNNNNCCGAA ACUGCCAA | 5896 |
| 1416 | CAAGCUGUC UCAGUGAC | 1741 | GUCACUGA CUGAUGAGGNNNNNNNNCCGAA ACAGCUUG | 5897 |
| 1418 | AGCUGUCUC AGUGACAA | 1742 | UUGUCACU CUGAUGAGGNNNNNNNNCCGAA AGACAGCU | 5898 |
| 1433 | AAACCCAUA CCCUUGUG | 1743 | CACAAGGG CUGAUGAGGNNNNNNNNCCGAA AUGGGUUU | 5899 |
| 1438 | CAUACCCUU GUGAAGAA | 1744 | UUCUUCAC CUGAUGAGGNNNNNNNNCCGAA AGGGUAUG | 5900 |
| 1466 | GGAGGACUU CCAGGGAG | 1745 | CUCCCUGG CUGAUGAGGNNNNNNNNCCGAA AGUCCUCC | 5901 |
| 1467 | GAGGACUUC CAGGGAGG | 1746 | CCUCCCUG CUGAUGAGGNNNNNNNNCCGAA AAGUCCUC | 5902 |
| 1480 | GAGGAAAUA AAAUUGAA | 1747 | UUCAAUUU CUGAUGAGGNNNNNNNNCCGAA AUUUCCUC | 5903 |
| 1485 | AAUAAAAUU GAAGUUAA | 1748 | UUAACUUC CUGAUGAGGNNNNNNNNCCGAA AUUUUAUU | 5904 |
| 1491 | AUUGAAGUU AAUAAAAA | 1749 | UUUUUAUU CUGAUGAGGNNNNNNNNCCGAA ACUUCAAU | 5905 |
| 1492 | UUGAAGUUA AUAAAAAU | 1750 | AUUUUUAU CUGAUGAGGNNNNNNNNCCGAA AACUUCAA | 5906 |
| 1495 | AAGUUAAUA AAAAUCAA | 1751 | UUGAUUUU CUGAUGAGGNNNNNNNNCCGAA AUUAACUU | 5907 |
| 1501 | AUAAAAAUC AAUUUGCU | 1752 | AGCAAAUU CUGAUGAGGNNNNNNNNCCGAA AUUUUUAU | 5908 |
| 1505 | AAAUCAAUU UGCUCUAA | 1753 | UUAGAGCA CUGAUGAGGNNNNNNNNCCGAA AUUGAUUU | 5909 |
| 1506 | AAUCAAUUU GCUCUAAU | 1754 | AUUAGAGC CUGAUGAGGNNNNNNNNCCGAA AAUUGAUU | 5910 |
| 1510 | AAUUUGCUC UAAUUGAA | 1755 | UUCAAUUA CUGAUGAGGNNNNNNNNCCGAA AGCAAAUU | 5911 |
| 1512 | UUUGCUCUA AUUGAAGG | 1756 | CCUUCAAU CUGAUGAGGNNNNNNNNCCGAA AGAGCAAA | 5912 |
| 1515 | GCUCUAAUU GAAGGAAA | 1757 | UUUCCUUC CUGAUGAGGNNNNNNNNCCGAA AUUAGAGC | 5913 |
| 1536 | AAAACUGUA AGUACCCU | 1758 | AGGGUACU CUGAUGAGGNNNNNNNNCCGAA ACAGUUUU | 5914 |
| 1540 | CUGUAAGUA CCCUUGUU | 1759 | AACAAGGG CUGAUGAGGNNNNNNNNCCGAA ACUUACAG | 5915 |
| 1545 | AGUACCCUU GUUAUCCA | 1760 | UGGAUAAC CUGAUGAGGNNNNNNNNCCGAA AGGGUACU | 5916 |
| 1548 | ACCCUUGUU AUCCAAGC | 1761 | GCUUGGAU CUGAUGAGGNNNNNNNNCCGAA ACAAGGGU | 5917 |
| 1549 | CCCUUGUUA UCCAAGCG | 1762 | CGCUUGGA CUGAUGAGGNNNNNNNNCCGAA AACAAGGG | 5918 |
| 1551 | CUUGUUAUC CAAGCGGC | 1763 | GCCGCUUG CUGAUGAGGNNNNNNNNCCGAA AUAACAAG | 5919 |
| 1568 | AAAUGUGUC AGCUUUGU | 1764 | ACAAAGCU CUGAUGAGGNNNNNNNNCCGAA ACACAUUU | 5920 |
| 1573 | UGUCAGCUU UGUACAAA | 1765 | UUUGUACA CUGAUGAGGNNNNNNNNCCGAA AGCUGACA | 5921 |
| 1574 | GUCAGCUUU GUACAAAU | 1766 | AUUUGUAC CUGAUGAGGNNNNNNNNCCGAA AAGCUGAC | 5922 |
| 1577 | AGCUUUGUA CAAAUGUG | 1767 | CACAUUUG CUGAUGAGGNNNNNNNNCCGAA ACAAAGCU | 5923 |
| 1593 | GAAGCGGUC AACAAAGU | 1768 | ACUUUGUU CUGAUGAGGNNNNNNNNCCGAA ACCGCUUC | 5924 |
| 1602 | AACAAAGUC GGGAGAGG | 1769 | CCUCUCCC CUGAUGAGGNNNNNNNNCCGAA ACUUUGUU | 5925 |
| 1623 | AGGGUGAUC UCCUUCCA | 1770 | UGGAAGGA CUGAUGAGGNNNNNNNNCCGAA AUCACCCU | 5926 |
| 1625 | GGUGAUCUC CUUCCACG | 1771 | CGUGGAAG CUGAUGAGGNNNNNNNNCCGAA AGAUCACC | 5927 |
| 1628 | GAUCUCCUU CCACGUGA | 1772 | UCACGUGG CUGAUGAGGNNNNNNNNCCGAA AGGAGAUC | 5928 |
| 1629 | AUCUCCUUC CACGUGAC | 1773 | GUCACGUG CUGAUGAGGNNNNNNNNCCGAA AAGGAGAU | 5929 |
| 1645 | CCAGGGGUC UGAAAUU | 1774 | AAUUUCAG CUGAUGAGGNNNNNNNNCCGAA ACCCCUGG | 5930 |
| 1653 | CCUGAAAUU ACUUUGCA | 1775 | UGCAAAGU CUGAUGAGGNNNNNNNNCCGAA AUUUCAGG | 5931 |
| 1654 | CUGAAAUUA CUUUGCAA | 1776 | UUGCAAAG CUGAUGAGGNNNNNNNNCCGAA AAUUUCAG | 5932 |
| 1657 | AAAUUACUU UGCAACCU | 1777 | AGGUUGCA CUGAUGAGGNNNNNNNNCCGAA AGUAAUUU | 5933 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 1658 | AAUUACUUU GCAACCUG | 1778 | CAGGUUGC CUGAUGAGGNNNNNNNNCCGAA AAGUAAUU | 5934 |
| 1697 | GAGCGUGUC UUUGUGGU | 1779 | ACCACAAA CUGAUGAGGNNNNNNNNCCGAA ACACGCUC | 5935 |
| 1699 | GCGUGUCUU UGUGGUGC | 1780 | GCACCACA CUGAUGAGGNNNNNNNNCCGAA AGACACGC | 5936 |
| 1700 | CGUGUCUUU GUGGUGCA | 1781 | UGCACCAC CUGAUGAGGNNNNNNNNCCGAA AAGACACG | 5937 |
| 1721 | AGACAGAUC UACGUUUG | 1782 | CAAACGUA CUGAUGAGGNNNNNNNNCCGAA AUCUGUCU | 5938 |
| 1723 | ACAGAUCUA CGUUUGAG | 1783 | CUCAAACG CUGAUGAGGNNNNNNNNCCGAA AGAUCUGU | 5939 |
| 1727 | AUCUACGUU UGAGAACC | 1784 | GGUUCUCA CUGAUGAGGNNNNNNNNCCGAA ACGUAGAU | 5940 |
| 1728 | UCUACGUUU GAGAACCU | 1785 | AGGUUCUC CUGAUGAGGNNNNNNNNCCGAA AACGUAGA | 5941 |
| 1737 | GAGAACCUC ACAUGGUA | 1786 | UACCAUGU CUGAUGAGGNNNNNNNNCCGAA AGGUUCUC | 5942 |
| 1745 | CACAUGGUA CAAGCUUG | 1787 | CAAGCUUG CUGAUGAGGNNNNNNNNCCGAA ACCAUGUG | 5943 |
| 1752 | UACAAGCUU GGCCCACA | 1788 | UGUGGGCC CUGAUGAGGNNNNNNNNCCGAA AGCUUGUA | 5944 |
| 1765 | CACAGCCUC UGCCAAUC | 1789 | GAUUGGCA CUGAUGAGGNNNNNNNNCCGAA AGGCUGUG | 5945 |
| 1773 | CUGCCAAUC CAUGUGGG | 1790 | CCCACAUG CUGAUGAGGNNNNNNNNCCGAA AUUGGCAG | 5946 |
| 1787 | GGGAGAGUU GCCCACAC | 1791 | GUGUGGGC CUGAUGAGGNNNNNNNNCCGAA ACUCUCCC | 5947 |
| 1800 | ACACCUGUU UGCAAGAA | 1792 | UUCUUGCA CUGAUGAGGNNNNNNNNCCGAA ACAGGUGU | 5948 |
| 1801 | CACCUGUUU GCAAGAAC | 1793 | GUUCUUGC CUGAUGAGGNNNNNNNNCCGAA AACAGGUG | 5949 |
| 1811 | CAAGAACUU GGAUACUC | 1794 | GAGUAUCC CUGAUGAGGNNNNNNNNCCGAA AGUUCUUG | 5950 |
| 1816 | ACUUGGAUA CUCUUUGG | 1795 | CCAAAGAG CUGAUGAGGNNNNNNNNCCGAA AUCCAAGU | 5951 |
| 1819 | UGGAUACUC UUUGGAAA | 1796 | UUUCCAAA CUGAUGAGGNNNNNNNNCCGAA AGUAUCCA | 5952 |
| 1821 | GAUACUCUU UGGAAAUU | 1797 | AAUUUCCA CUGAUGAGGNNNNNNNNCCGAA AGAGUAUC | 5953 |
| 1822 | AUACUCUUU GGAAAUUG | 1798 | CAAUUUCC CUGAUGAGGNNNNNNNNCCGAA AAGAGUAU | 5954 |
| 1829 | UUGGAAAUU GAAUGCCA | 1799 | UGGCAUUC CUGAUGAGGNNNNNNNNCCGAA AUUUCCAA | 5955 |
| 1844 | CACCAUGUU CUCUAAUA | 1800 | UAUUAGAG CUGAUGAGGNNNNNNNNCCGAA ACAUGGUG | 5956 |
| 1845 | ACCAUGUUC UCUAAUAG | 1801 | CUAUUAGA CUGAUGAGGNNNNNNNNCCGAA AACAUGGU | 5957 |
| 1847 | CAUGUUCUC UAAUAGCA | 1802 | UGCUAUUA CUGAUGAGGNNNNNNNNCCGAA AGAACAUG | 5958 |
| 1849 | UGUUCUCUA AUAGCACA | 1803 | UGUGCUAU CUGAUGAGGNNNNNNNNCCGAA AGAGAACA | 5959 |
| 1852 | UCUCUAAUA GCACAAAU | 1804 | AUUUGUGC CUGAUGAGGNNNNNNNNCCGAA AUUAGAGA | 5960 |
| 1866 | AAUGCAUU UUGAUCAU | 1805 | AUGAUCAA CUGAUGAGGNNNNNNNNCCGAA AUGUCAUU | 5961 |
| 1867 | AUGACAUUU UGAUCAUG | 1806 | CAUGAUCA CUGAUGAGGNNNNNNNNCCGAA AAUGUCAU | 5962 |
| 1868 | UGACAUUUU GAUCAUGG | 1807 | CCAUGAUC CUGAUGAGGNNNNNNNNCCGAA AAAUGUCA | 5963 |
| 1872 | AUUUUGAUC AUGGAGCU | 1808 | AGCUCCAU CUGAUGAGGNNNNNNNNCCGAA AUCAAAAU | 5964 |
| 1881 | AUGGAGCUU AAGAAUGC | 1809 | GCAUUCUU CUGAUGAGGNNNNNNNNCCGAA AGCUCCAU | 5965 |
| 1882 | UGGAGCUUA AGAAUGCA | 1810 | UGCAUUCU CUGAUGAGGNNNNNNNNCCGAA AAGCUCCA | 5966 |
| 1892 | GAAUGCAUC CUUGCAGG | 1811 | CCUGCAAG CUGAUGAGGNNNNNNNNCCGAA AUGCAUUC | 5967 |
| 1895 | UGCAUCCUU GCAGGACC | 1812 | GGUCCUGC CUGAUGAGGNNNNNNNNCCGAA AGGAUGCA | 5968 |
| 1913 | AGGAGACUA UGUCUGCC | 1813 | GGCAGACA CUGAUGAGGNNNNNNNNCCGAA AGUCUCCU | 5969 |
| 1917 | GACUAUGUC UGCCUUGC | 1814 | GCAAGGCA CUGAUGAGGNNNNNNNNCCGAA ACAUAGUC | 5970 |
| 1923 | GUCUGCCUU GCUCAAGA | 1815 | UCUUGAGC CUGAUGAGGNNNNNNNNCCGAA AGGCAGAC | 5971 |
| 1927 | GCCUUGCUC AAGACAGG | 1816 | CCUGUCUU CUGAUGAGGNNNNNNNNCCGAA ACAAGGCC | 5972 |
| 1954 | AAAGACAUU GCGUGGUC | 1817 | GACCACGC CUGAUGAGGNNNNNNNNCCGAA AUGUCUUU | 5973 |
| 1962 | UGCGUGGUC AGGCAGCU | 1818 | AGCUGCCU CUGAUGAGGNNNNNNNNCCGAA ACCACGCA | 5974 |
| 1971 | AGGCAGCUC ACAGUCCU | 1819 | AGGACUGU CUGAUGAGGNNNNNNNNCCGAA AGCUGCCU | 5975 |
| 1977 | CUCACAGUC CUAGAGCG | 1820 | CGCUCUAG CUGAUGAGGNNNNNNNNCCGAA ACUGUGAG | 5976 |
| 1980 | ACAGUCCUA GAGCGUGU | 1821 | ACACGCUC CUGAUGAGGNNNNNNNNCCGAA AGGACUGU | 5977 |
| 2001 | CCCACGAUC ACAGGAAA | 1822 | UUUCCUGU CUGAUGAGGNNNNNNNNCCGAA AUCGUGGG | 5978 |
| 2020 | UGGAGAAUC AGACGACA | 1823 | UGUCGUCU CUGAUGAGGNNNNNNNNCCGAA AUUCUCCA | 5979 |
| 2032 | CGACAAGUA UUGGGGAA | 1824 | UUCCCCAA CUGAUGAGGNNNNNNNNCCGAA ACUUGUCG | 5980 |
| 2034 | ACAAGUAUU GGGGAAAG | 1825 | CUUUCCCC CUGAUGAGGNNNNNNNNCCGAA AUACUUGU | 5981 |
| 2046 | GAAAGCAUC GAAGUCUC | 1826 | GAGACUUC CUGAUGAGGNNNNNNNNCCGAA AUGCUUUC | 5982 |
| 2052 | AUCGAAGUC UCAUGCAC | 1827 | GUGCAUGA CUGAUGAGGNNNNNNNNCCGAA ACUUCGAU | 5983 |
| 2054 | CGAAGUCUC AUGCACGG | 1828 | CCGUGCAU CUGAUGAGGNNNNNNNNCCGAA AGACUUCG | 5984 |
| 2066 | CACGGCAUC UGGGAAUC | 1829 | GAUUCCCA CUGAUGAGGNNNNNNNNCCGAA AUGCCGUG | 5985 |
| 2074 | CUGGGAAUC CCCCUCCA | 1830 | UGGAGGGG CUGAUGAGGNNNNNNNNCCGAA AUUCCCAG | 5986 |
| 2080 | AUCCCCCUC CACAGAUC | 1831 | GAUCUGUG CUGAUGAGGNNNNNNNNCCGAA AGGGGGAU | 5987 |
| 2088 | CCACAGAUC AUGUGGUU | 1832 | AACCACAU CUGAUGAGGNNNNNNNNCCGAA AUCUGUGG | 5988 |
| 2096 | CAUGUGGUU UAAAGAUA | 1833 | UAUCUUUA CUGAUGAGGNNNNNNNNCCGAA ACCACAUG | 5989 |
| 2097 | AUGUGGUUU AAAGAUAA | 1834 | UUAUCUUU CUGAUGAGGNNNNNNNNCCGAA AACCACAU | 5990 |
| 2098 | UGUGGUUUA AAGAUAAU | 1835 | AUUAUCUU CUGAUGAGGNNNNNNNNCCGAA AAACCACA | 5991 |
| 2104 | UUAAAGAUA AUGAGACC | 1836 | GGUCUCAU CUGAUGAGGNNNNNNNNCCGAA AUCUUUAA | 5992 |
| 2115 | GAGACCCUU GUAGAAGA | 1837 | UCUUCUAC CUGAUGAGGNNNNNNNNCCGAA AGGGUCUC | 5993 |
| 2118 | ACCCUUGUA GAAGACUC | 1838 | GAGUCUUC CUGAUGAGGNNNNNNNNCCGAA ACAAGGGU | 5994 |
| 2126 | AGAAGACUC AGGCAUUG | 1839 | CAAUGCCU CUGAUGAGGNNNNNNNNCCGAA AGUCUUCU | 5995 |
| 2133 | UCAGGCAUU GUAUUGAA | 1840 | UUCAAUAC CUGAUGAGGNNNNNNNNCCGAA AUGCCUGA | 5996 |
| 2136 | GGCAUUGUA UUGAAGGA | 1841 | UCCUUCAA CUGAUGAGGNNNNNNNNCCGAA ACAAUGCC | 5997 |
| 2138 | CAUUGUAUU GAAGGAUG | 1842 | CAUCCUUC CUGAUGAGGNNNNNNNNCCGAA AUACAAUG | 5998 |
| 2160 | CGGAACCUC ACUAUCCG | 1843 | CGGAUAGU CUGAUGAGGNNNNNNNNCCGAA AGGUUCCG | 5999 |
| 2164 | ACCUCACUA UCCGCAGA | 1844 | UCUGCGGA CUGAUGAGGNNNNNNNNCCGAA AGUGAGGU | 6000 |
| 2166 | CUCACUAUC CGCAGAGU | 1845 | ACUCUGCG CUGAUGAGGNNNNNNNNCCGAA AUAGUGAG | 6001 |
| 2196 | GAAGGCCUC UACACCUG | 1846 | CAGGUGUA CUGAUGAGGNNNNNNNNCCGAA AGGCCUUC | 6002 |
| 2198 | AGGCCUCUA CACCUGCC | 1847 | GGCAGGUG CUGAUGAGGNNNNNNNNCCGAA AGAGGCCU | 6003 |
| 2220 | UGCAGUGUU CUUGGCUG | 1848 | CAGCCAAG CUGAUGAGGNNNNNNNNCCGAA ACACUGCA | 6004 |
| 2221 | GCAGUGUUC UUGGCUGU | 1849 | ACAGCCAA CUGAUGAGGNNNNNNNNCCGAA AACACUGC | 6005 |
| 2223 | AGUGUUCUU GGCUGUGC | 1850 | GCACAGCC CUGAUGAGGNNNNNNNNCCGAA AGAACACU | 6006 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 2246 | GGAGGCAUU UUUCAUAA | 1851 | UUAUGAAA CUGAUGAGGNNNNNNNNCCGAA AUGCCUCC | 6007 |
| 2247 | GAGGCAUUU UUCAUAAU | 1852 | AUUAUGAA CUGAUGAGGNNNNNNNNCCGAA AAUGCCUC | 6008 |
| 2248 | AGGCAUUUU UCAUAAUA | 1853 | UAUUAUGA CUGAUGAGGNNNNNNNNCCGAA AAAUGCCU | 6009 |
| 2249 | GGCAUUUUU CAUAAUAG | 1854 | CUAUUAUG CUGAUGAGGNNNNNNNNCCGAA AAAAUGCC | 6010 |
| 2250 | GCAUUUUUC AUAAUAGA | 1855 | UCUAUUAU CUGAUGAGGNNNNNNNNCCGAA AAAAAUGC | 6011 |
| 2253 | UUUUUCAUA AUAGAAGG | 1856 | CCUUCUAU CUGAUGAGGNNNNNNNNCCGAA AUGAAAAA | 6012 |
| 2256 | UUCAUAAUA GAAGGUGC | 1857 | GCACCUUC CUGAUGAGGNNNNNNNNCCGAA AUUAUGAA | 6013 |
| 2282 | GACGAACUU GGAAAUCA | 1858 | UGAUUUCC CUGAUGAGGNNNNNNNNCCGAA AGUUCGUC | 6014 |
| 2289 | UUGGAAAUC AUUAUUCU | 1859 | AGAAUAAU CUGAUGAGGNNNNNNNNCCGAA AUUUCCAA | 6015 |
| 2292 | GAAAUCAUU AUUCUAGU | 1860 | ACUAGAAU CUGAUGAGGNNNNNNNNCCGAA AAUGAUUC | 6016 |
| 2293 | AAAUCAUUA UUCUAGUA | 1861 | UACUAGAA CUGAUGAGGNNNNNNNNCCGAA AAUGAUUU | 6017 |
| 2295 | AUCAUUAUU CUAGUAGG | 1862 | CCUACUAG CUGAUGAGGNNNNNNNNCCGAA AUAAUGAU | 6018 |
| 2296 | UCAUUAUUC UAGUAGGC | 1863 | GCCUACUA CUGAUGAGGNNNNNNNNCCGAA AAUAAUGA | 6019 |
| 2298 | AUUAUUCUA GUAGGCAC | 1864 | GUGCCUAC CUGAUGAGGNNNNNNNNCCGAA AGAAUAAU | 6020 |
| 2301 | AUUCUAGUA GGCACGAC | 1865 | GUCGUGCC CUGAUGAGGNNNNNNNNCCGAA ACUAGAAU | 6021 |
| 2316 | ACGGUGAUU GCCAUGUU | 1866 | AACAUGGC CUGAUGAGGNNNNNNNNCCGAA AUCACCGU | 6022 |
| 2324 | UGCCAUGUU CUUCUGGC | 1867 | GCCAGAAG CUGAUGAGGNNNNNNNNCCGAA ACAUGGCA | 6023 |
| 2325 | GCCAUGUUC UUCUGGCU | 1868 | AGCCAGAA CUGAUGAGGNNNNNNNNCCGAA AACAUGGC | 6024 |
| 2327 | CAUGUUCUU CUGGCUAC | 1869 | GUAGCCAG CUGAUGAGGNNNNNNNNCCGAA AGAACAUG | 6025 |
| 2328 | AUGUUCUUC UGGCUACU | 1870 | AGUAGCCA CUGAUGAGGNNNNNNNNCCGAA AAGAACAU | 6026 |
| 2334 | UUCUGGCUA CUUCUUGU | 1871 | ACAAGAAG CUGAUGAGGNNNNNNNNCCGAA AGCCAGAA | 6027 |
| 2337 | UGGCUACUU CUUGUCAU | 1872 | AUGACAAG CUGAUGAGGNNNNNNNNCCGAA AGUAGCCA | 6028 |
| 2338 | GGCUACUUC UUGUCAUC | 1873 | GAUGACAA CUGAUGAGGNNNNNNNNCCGAA AAGUAGCC | 6029 |
| 2340 | CUACUUCUU GUCAUCAU | 1874 | AUGAUGAC CUGAUGAGGNNNNNNNNCCGAA AGAAGUAG | 6030 |
| 2343 | CUUCUUGUC AUCAUCCU | 1875 | AGGAUGAU CUGAUGAGGNNNNNNNNCCGAA ACAAGAAG | 6031 |
| 2346 | CUUGUCAUC AUCCUAGG | 1876 | CCUAGGAU CUGAUGAGGNNNNNNNNCCGAA AUGACAAG | 6032 |
| 2349 | GUCAUCAUC CUAGGGAC | 1877 | GUCCCUAG CUGAUGAGGNNNNNNNNCCGAA AUGAUGAC | 6033 |
| 2352 | AUCAUCCUA GGGACCGU | 1878 | ACGGUCCC CUGAUGAGGNNNNNNNNCCGAA AGGAUGAU | 6034 |
| 2361 | GGGACCGUU AAGCGGGC | 1879 | GCCCGCUU CUGAUGAGGNNNNNNNNCCGAA ACGGUCCC | 6035 |
| 2362 | GGACCGUUA AGCGGGCC | 1880 | GGCCCGCU CUGAUGAGGNNNNNNNNCCGAA AACGGUCC | 6036 |
| 2396 | GACAGGCUA CUUGUCCA | 1881 | UGGACAAG CUGAUGAGGNNNNNNNNCCGAA AGCCUGUC | 6037 |
| 2399 | AGGCUACUU GUCCAUCG | 1882 | CGAUGGAC CUGAUGAGGNNNNNNNNCCGAA AGUAGCCU | 6038 |
| 2402 | CUACUUGUC CAUCGUCA | 1883 | UGACGAUG CUGAUGAGGNNNNNNNNCCGAA ACAAGUAG | 6039 |
| 2406 | UUGUCCAUC GUCAUGGA | 1884 | UCCAUGAC CUGAUGAGGNNNNNNNNCCGAA AUGGACAA | 6040 |
| 2409 | UCCAUCGUC AUGGAUCC | 1885 | GGAUCCAU CUGAUGAGGNNNNNNNNCCGAA ACGAUGGA | 6041 |
| 2416 | UCAUGGAUC CAGAUGAA | 1886 | UUCAUCUG CUGAUGAGGNNNNNNNNCCGAA AUCCAUGA | 6042 |
| 2427 | GAUGAACUC CCAUUGGA | 1887 | UCCAAUGG CUGAUGAGGNNNNNNNNCCGAA AGUUCAUC | 6043 |
| 2432 | ACUCCCAUU GGAUGAAC | 1888 | GUUCAUCC CUGAUGAGGNNNNNNNNCCGAA AUGGGAGU | 6044 |
| 2443 | AUGAACAUU GUGAACGA | 1889 | UCGUUCAC CUGAUGAGGNNNNNNNNCCGAA AUGUUCAU | 6045 |
| 2458 | GACUGCCUU AUGAUGCC | 1890 | GGCAUCAU CUGAUGAGGNNNNNNNNCCGAA AGGCAGUC | 6046 |
| 2459 | ACUGCCUUA UGAUGCCA | 1891 | UGGCAUCA CUGAUGAGGNNNNNNNNCCGAA AAGGCAGU | 6047 |
| 2480 | AUGGGAAUU CCCCAGAG | 1892 | CUCUGGGG CUGAUGAGGNNNNNNNNCCGAA AUUCCCAU | 6048 |
| 2481 | UGGGAAUUC CCCAGAGA | 1893 | UCUCUGGG CUGAUGAGGNNNNNNNNCCGAA AAUUCCCA | 6049 |
| 2502 | CUGAACCUA GGUAAGCC | 1894 | GGCUUACC CUGAUGAGGNNNNNNNNCCGAA AGGUUCAG | 6050 |
| 2506 | ACCUAGGUA AGCCUCUU | 1895 | AAGAGGCU CUGAUGAGGNNNNNNNNCCGAA ACCUAGGU | 6051 |
| 2512 | GUAAGCCUC UUGGCCGU | 1896 | ACGGCCAA CUGAUGAGGNNNNNNNNCCGAA AGGCUUAC | 6052 |
| 2514 | AAGCCUCUU GGCCGUGG | 1897 | CCACGGCC CUGAUGAGGNNNNNNNNCCGAA AGAGGCUU | 6053 |
| 2528 | UGGUGCCUU UGGCCAAG | 1898 | CUUGGCCA CUGAUGAGGNNNNNNNNCCGAA AGGCACCA | 6054 |
| 2529 | GGUGCCUUU GGCCAAGA | 1899 | UCUUGGCC CUGAUGAGGNNNNNNNNCCGAA AAGGCACC | 6055 |
| 2541 | CAAGAGAUU GAAGCAGA | 1900 | UCUGCUUC CUGAUGAGGNNNNNNNNCCGAA AUCUCUUG | 6056 |
| 2555 | AGAUGCCUU UGGAAUUG | 1901 | CAAUUCCA CUGAUGAGGNNNNNNNNCCGAA AGGCAUCU | 6057 |
| 2556 | GAUGCCUUU GGAAUUGA | 1902 | UCAAUUCC CUGAUGAGGNNNNNNNNCCGAA AAGGCAUC | 6058 |
| 2562 | UUUGGAAUU GACAAGAC | 1903 | GUCUUGUC CUGAUGAGGNNNNNNNNCCGAA AUUCCAAA | 6059 |
| 2578 | CAGCAACUU GCAGGACA | 1904 | UGUCCUGC CUGAUGAGGNNNNNNNNCCGAA AGUUGCUG | 6060 |
| 2589 | AGGACAGUA GCAGUCAA | 1905 | UUGACUGC CUGAUGAGGNNNNNNNNCCGAA ACUGUCCU | 6061 |
| 2595 | GUAGCAGUC AAAAUGUU | 1906 | AACAUUUU CUGAUGAGGNNNNNNNNCCGAA ACUGCUAC | 6062 |
| 2603 | CAAAAUGUU GAAAGAAG | 1907 | CUUCUUUC CUGAUGAGGNNNNNNNNCCGAA ACAUUUUG | 6063 |
| 2632 | GUGAGCAUC GAGCUCUC | 1908 | GAGAGCUC CUGAUGAGGNNNNNNNNCCGAA AUGCUCAC | 6064 |
| 2638 | AUCGAGCUC UCAUGUCU | 1909 | AGACAUGA CUGAUGAGGNNNNNNNNCCGAA AGCUCGAU | 6065 |
| 2640 | CGAGCUCUC AUGUCUGA | 1910 | UCAGACAU CUGAUGAGGNNNNNNNNCCGAA AGAGCUCG | 6066 |
| 2645 | UCUCAUGUC UGAACUCA | 1911 | UGAGUUCA CUGAUGAGGNNNNNNNNCCGAA ACAUGAGA | 6067 |
| 2652 | UCUGAACUC AAGAUCCU | 1912 | AGGAUCUU CUGAUGAGGNNNNNNNNCCGAA AGUUCAGA | 6068 |
| 2658 | CUCAAGAUC CUCAUUCA | 1913 | UGAAUGAG CUGAUGAGGNNNNNNNNCCGAA AUCUUGAG | 6069 |
| 2661 | AAGAUCCUC AUUCAUAU | 1914 | AUAUGAAU CUGAUGAGGNNNNNNNNCCGAA AGGAUCUU | 6070 |
| 2664 | AUCCUCAUU CAUAUUGG | 1915 | CCAAUAUG CUGAUGAGGNNNNNNNNCCGAA AUGAGGAU | 6071 |
| 2665 | UCCUCAUUC AUAUUGGU | 1916 | ACCAAUAU CUGAUGAGGNNNNNNNNCCGAA AAUGAGGA | 6072 |
| 2668 | UCAUUCAUA UUGGUCAC | 1917 | GUGACCAA CUGAUGAGGNNNNNNNNCCGAA AUGAAUGA | 6073 |
| 2670 | AUUCAUAUU GGUCACCA | 1918 | UGGUGACC CUGAUGAGGNNNNNNNNCCGAA AUAUGAAU | 6074 |
| 2674 | AUAUUGGUC ACCAUCUC | 1919 | GAGAUGGU CUGAUGAGGNNNNNNNNCCGAA ACCAAUAU | 6075 |
| 2680 | GUCACCAUC UCAAUGUG | 1920 | CACAUUGA CUGAUGAGGNNNNNNNNCCGAA AUGGUGAC | 6076 |
| 2682 | CACCAUCUC AAUGUGGU | 1921 | ACCACAUU CUGAUGAGGNNNNNNNNCCGAA AGAUGGUG | 6077 |
| 2691 | AAUGUGGUC AACCUUCU | 1922 | AGAAGGUU CUGAUGAGGNNNNNNNNCCGAA ACCACAUU | 6078 |
| 2697 | GUCAACCUU CUAGGUGC | 1923 | GCACCUAG CUGAUGAGGNNNNNNNNCCGAA AGGUUGAC | 6079 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 2698 | UCAACCUUC UAGGUGCC | 1924 | GGCACCUA CUGAUGAGGNNNNNNNNCCGAA AAGGUUGA | 6080 |
| 2700 | AACCUUCUA GGUGCCUG | 1925 | CAGGCACC CUGAUGAGGNNNNNNNNCCGAA AGAAGGUU | 6081 |
| 2710 | GUGCCUGUA CCAAGCCA | 1926 | UGGCUUGG CUGAUGAGGNNNNNNNNCCGAA ACAGGCAC | 6082 |
| 2730 | GGGCCACUC AUGGUGAU | 1927 | AUCACCAU CUGAUGAGGNNNNNNNNCCGAA AGUGGCCC | 6083 |
| 2739 | AUGGUGAUU GUGGAAUU | 1928 | AAUUCCAC CUGAUGAGGNNNNNNNNCCGAA AUCACCAU | 6084 |
| 2747 | UGUGGAAUU CUGCAAAU | 1929 | AUUUGCAG CUGAUGAGGNNNNNNNNCCGAA AUUCCACA | 6085 |
| 2748 | GUGGAAUUC UGCAAAUU | 1930 | AAUUUGCA CUGAUGAGGNNNNNNNNCCGAA AAUUCCAC | 6086 |
| 2756 | CUGCAAAUU UGGAAACC | 1931 | GGUUUCCA CUGAUGAGGNNNNNNNNCCGAA AUUUGCAG | 6087 |
| 2757 | UGCAAAUUU GGAAACCU | 1932 | AGGUUUCC CUGAUGAGGNNNNNNNNCCGAA AAUUUGCA | 6088 |
| 2768 | AAACCUGUC CACUUACC | 1933 | GGUAAGUG CUGAUGAGGNNNNNNNNCCGAA ACAGGUUU | 6089 |
| 2773 | UGUCCACUU ACCUGAGG | 1934 | CCUCAGGU CUGAUGAGGNNNNNNNNCCGAA AGUGGACA | 6090 |
| 2774 | GUCCACUUA CCUGAGGA | 1935 | UCCUCAGG CUGAUGAGGNNNNNNNNCCGAA AAGUGGAC | 6091 |
| 2798 | AAAUGAAUU UGUCCCCU | 1936 | AGGGGACA CUGAUGAGGNNNNNNNNCCGAA AUUCAUUU | 6092 |
| 2799 | AAUGAAUUU GUCCCCUA | 1937 | UAGGGGAC CUGAUGAGGNNNNNNNNCCGAA AAUUCAUU | 6093 |
| 2802 | GAAUUUGUC CCCUACAA | 1938 | UUGUAGGG CUGAUGAGGNNNNNNNNCCGAA ACAAAUUC | 6094 |
| 2807 | UGUCCCCUA CAAGACCA | 1939 | UGGUCUUG CUGAUGAGGNNNNNNNNCCGAA AGGGGACA | 6095 |
| 2828 | GGCACGAUU CCGUCAAG | 1940 | CUUGACGG CUGAUGAGGNNNNNNNNCCGAA AUCGUGCC | 6096 |
| 2829 | GCACGAUUC CGUCAAGG | 1941 | CCUUGACG CUGAUGAGGNNNNNNNNCCGAA AAUCGUGC | 6097 |
| 2833 | GAUUCCGUC AAGGGAAA | 1942 | UUUCCCUU CUGAUGAGGNNNNNNNNCCGAA ACGGAAUC | 6098 |
| 2846 | GAAAGACUA CGUUGGAG | 1943 | CUCCAACG CUGAUGAGGNNNNNNNNCCGAA AGUCUUUC | 6099 |
| 2850 | GACUACGUU GGAGCAAU | 1944 | AUUGCUCC CUGAUGAGGNNNNNNNNCCGAA ACGUAGUC | 6100 |
| 2859 | GGAGCAAUC CCUGUGGA | 1945 | UCCACAGG CUGAUGAGGNNNNNNNNCCGAA AUUGCUCC | 6101 |
| 2869 | CUGUGGAUC UGAAACGG | 1946 | CCGUUUCA CUGAUGAGGNNNNNNNNCCGAA AUCCACAG | 6102 |
| 2882 | ACGGCGCUU GGACAGCA | 1947 | UGCUGUCC CUGAUGAGGNNNNNNNNCCGAA AGCGCCGU | 6103 |
| 2892 | GACAGCAUC ACCAGUAG | 1948 | CUACUGGU CUGAUGAGGNNNNNNNNCCGAA AUGCUGUC | 6104 |
| 2899 | UCACCAGUA GCCAGAGC | 1949 | GCUCUGGC CUGAUGAGGNNNNNNNNCCGAA ACUGGUGA | 6105 |
| 2909 | CCAGAGCUC AGCCAGCU | 1950 | AGCUGGCU CUGAUGAGGNNNNNNNNCCGAA AGCUCUGG | 6106 |
| 2918 | AGCCAGCUC UGGAUUUG | 1951 | CAAAUCCA CUGAUGAGGNNNNNNNNCCGAA AGCUGGCU | 6107 |
| 2924 | CUCUGGAUU UGUGGAGG | 1952 | CCUCCACA CUGAUGAGGNNNNNNNNCCGAA AUCCAGAG | 6108 |
| 2925 | UCUGGAUUU GUGGAGGA | 1953 | UCCUCCAC CUGAUGAGGNNNNNNNNCCGAA AAUCCAGA | 6109 |
| 2939 | GGAGAAGUC CCUCAGUG | 1954 | CACUGAGG CUGAUGAGGNNNNNNNNCCGAA ACUUCUCC | 6110 |
| 2943 | AAGUCCCUC AGUGAUGU | 1955 | ACAUCACU CUGAUGAGGNNNNNNNNCCGAA AGGGACUU | 6111 |
| 2952 | AGUGAUGUA GAAGAAGA | 1956 | UCUUCUUC CUGAUGAGGNNNNNNNNCCGAA ACAUCACU | 6112 |
| 2968 | AGGAAGCUC CUGAAGAU | 1957 | AUCUUCAG CUGAUGAGGNNNNNNNNCCGAA AGCUUCCU | 6113 |
| 2977 | CUGAAGAUC UGUAUAAG | 1958 | CUUAUACA CUGAUGAGGNNNNNNNNCCGAA AUCUUCAG | 6114 |
| 2981 | AGAUCUGUA UAAGGACU | 1959 | AGUCCUUA CUGAUGAGGNNNNNNNNCCGAA ACAGAUCU | 6115 |
| 2983 | AUCUGUAUA AGGACUUC | 1960 | GAAGUCCU CUGAUGAGGNNNNNNNNCCGAA AUACAGAU | 6116 |
| 2990 | UAAGGACUU CCUGACCU | 1961 | AGGUCAGG CUGAUGAGGNNNNNNNNCCGAA AGUCCUUA | 6117 |
| 2991 | AAGGACUUC CUGACCUU | 1962 | AAGGUCAG CUGAUGAGGNNNNNNNNCCGAA AAGUCCUU | 6118 |
| 2999 | CCUGACCUU GGAGCAUC | 1963 | GAUGCUCC CUGAUGAGGNNNNNNNNCCGAA AGGUCAGG | 6119 |
| 3007 | UGGAGCAUC UCAUCUGU | 1964 | ACAGAUGA CUGAUGAGGNNNNNNNNCCGAA AUGCUCCA | 6120 |
| 3009 | GAGCAUCUC AUCUGUUA | 1965 | UAACAGAU CUGAUGAGGNNNNNNNNCCGAA AGAUGCUC | 6121 |
| 3012 | CAUCUCAUC UGUUACAG | 1966 | CUGUAACA CUGAUGAGGNNNNNNNNCCGAA AUGAGAUG | 6122 |
| 3016 | UCAUCUGUU ACAGCUUC | 1967 | GAAGCUGU CUGAUGAGGNNNNNNNNCCGAA ACAGAUGA | 6123 |
| 3017 | CAUCUGUUA CAGCUUCC | 1968 | GGAAGCUG CUGAUGAGGNNNNNNNNCCGAA AACAGAUG | 6124 |
| 3023 | UUACAGCUU CCAAGUGG | 1969 | CCACUUGG CUGAUGAGGNNNNNNNNCCGAA AGCUGUAA | 6125 |
| 3024 | UACAGCUUC CAAGUGGC | 1970 | GCCACUUG CUGAUGAGGNNNNNNNNCCGAA AAGCUGUA | 6126 |
| 3034 | AAGUGGCUA AGGGCAUG | 1971 | CAUGCCCU CUGAUGAGGNNNNNNNNCCGAA AGCCACUU | 6127 |
| 3047 | CAUGGAGUU CUUGGCAU | 1972 | AUGCCAAG CUGAUGAGGNNNNNNNNCCGAA ACUCCAUG | 6128 |
| 3048 | AUGGAGUUC UUGGCAUC | 1973 | GAUGCCAA CUGAUGAGGNNNNNNNNCCGAA AACUCCAU | 6129 |
| 3050 | GGAGUUCUU GGCAUCGC | 1974 | GCGAUGCC CUGAUGAGGNNNNNNNNCCGAA AGAACUCC | 6130 |
| 3056 | CUUGGCAUC GCGAAAGU | 1975 | ACUUUCGC CUGAUGAGGNNNNNNNNCCGAA AUGCCAAG | 6131 |
| 3067 | GAAAGUGUA UCCACAGG | 1976 | CCUGUGGA CUGAUGAGGNNNNNNNNCCGAA ACACUUUC | 6132 |
| 3069 | AAGUGUAUC CACAGGGA | 1977 | UCCCUGUG CUGAUGAGGNNNNNNNNCCGAA AUACACUU | 6133 |
| 3094 | CACGAAAUA UCCUCUUA | 1978 | UAAGAGGA CUGAUGAGGNNNNNNNNCCGAA AUUUCGUG | 6134 |
| 3096 | CGAAAUAUC CUCUUAUC | 1979 | GAUAAGAG CUGAUGAGGNNNNNNNNCCGAA AUAUUUCG | 6135 |
| 3099 | AAUAUCCUC UUAUCGGA | 1980 | UCCGAUAA CUGAUGAGGNNNNNNNNCCGAA AGGAUAUU | 6136 |
| 3101 | UAUCCUCUU AUCGGAGA | 1981 | UCUCCGAU CUGAUGAGGNNNNNNNNCCGAA AGAGGAUA | 6137 |
| 3102 | AUCCUCUUA UCGGAGAA | 1982 | UUCUCCGA CUGAUGAGGNNNNNNNNCCGAA AAGAGGAU | 6138 |
| 3104 | CCUCUUAUC GGAGAAGG | 1983 | UCUUCUCC CUGAUGAGGNNNNNNNNCCGAA AUAAGAGG | 6139 |
| 3120 | AACGUGGUU AAAAUCUG | 1984 | CAGAUUUU CUGAUGAGGNNNNNNNNCCGAA ACCACGUU | 6140 |
| 3121 | ACGUGGUUA AAAUCUGU | 1985 | ACAGAUUU CUGAUGAGGNNNNNNNNCCGAA AACCACGU | 6141 |
| 3126 | GUUAAAAUC UGUGACUU | 1986 | AAGUCACA CUGAUGAGGNNNNNNNNCCGAA AUUUUAAC | 6142 |
| 3134 | CUGUGACUU UGGCUUGG | 1987 | CCAAGCCA CUGAUGAGGNNNNNNNNCCGAA AGUCACAG | 6143 |
| 3135 | UGUGACUUU GGCUUGGC | 1988 | GCCAAGCC CUGAUGAGGNNNNNNNNCCGAA AAGUCACA | 6144 |
| 3140 | CUUUGGCUU GGCCCGGG | 1989 | CCCGGGCC CUGAUGAGGNNNNNNNNCCGAA AGCCAAAG | 6145 |
| 3151 | CCCGGGAUA UUUAUAAA | 1990 | UUUAUAAA CUGAUGAGGNNNNNNNNCCGAA AUCCCGGG | 6146 |
| 3153 | CGGGAUAUU UAUAAAGA | 1991 | UCUUUAUA CUGAUGAGGNNNNNNNNCCGAA AUAUCCCG | 6147 |
| 3154 | GGGAUAUUU AUAAAGAU | 1992 | AUCUUUAU CUGAUGAGGNNNNNNNNCCGAA AAUAUCCC | 6148 |
| 3155 | GGAUAUUUA UAAAGAUC | 1993 | GAUCUUUA CUGAUGAGGNNNNNNNNCCGAA AAAUAUCC | 6149 |
| 3157 | AUAUUUAUA AAGAUCCA | 1994 | UGGAUCUU CUGAUGAGGNNNNNNNNCCGAA AUAAAUAU | 6150 |
| 3163 | AUAAAGAUC CAGAUUAU | 1995 | AUAAUCUG CUGAUGAGGNNNNNNNNCCGAA AUCUUUAU | 6151 |
| 3169 | AUCCAGAUU AUGUCAGA | 1996 | UCUGACAU CUGAUGAGGNNNNNNNNCCGAA AUCUGGAU | 6152 |

TABLE IV-continued

| Pos | Substrate | Seq ID No | HH Ribozyme Sequence (Human KDR VEGF Receptor-Hammerhead Ribozyme and Substrate Sequence) | Seq ID No |
|---|---|---|---|---|
| 3170 | UCCAGAUUA UGUCAGAA | 1997 | UUCUGACA CUGAUGAGGNNNNNNNNCCGAA AAUCUGGA | 6153 |
| 3174 | GAUUAUGUC AGAAAAGG | 1998 | CCUUUUCU CUGAUGAGGNNNNNNNNCCGAA ACAUAAUC | 6154 |
| 3190 | GAGAUGCUC GCCUCCCU | 1999 | AGGGAGGC CUGAUGAGGNNNNNNNNCCGAA AGCAUCUC | 6155 |
| 3195 | GCUCGCCUC CCUUUGAA | 2000 | UUCAAAGG CUGAUGAGGNNNNNNNNCCGAA AGGCGAGC | 6156 |
| 3199 | GCCUCCCUU UGAAAUGG | 2001 | CCAUUUCA CUGAUGAGGNNNNNNNNCCGAA AGGGAGGC | 6157 |
| 3200 | CCUCCCUUU GAAAUGGA | 2002 | UCCAUUUC CUGAUGAGGNNNNNNNNCCGAA AAGGGAGG | 6158 |
| 3225 | GAAACAAUU UUUGACAG | 2003 | CUGUCAAA CUGAUGAGGNNNNNNNNCCGAA AUUGUUUC | 6159 |
| 3226 | AAACAAUUU UUGACAGA | 2004 | UCUGUCAA CUGAUGAGGNNNNNNNNCCGAA AAUUGUUU | 6160 |
| 3227 | AACAAUUUU UGACAGAG | 2005 | CUCUGUCA CUGAUGAGGNNNNNNNNCCGAA AAAUUGUU | 6161 |
| 3228 | ACAAUUUUU GACAGAGU | 2006 | ACUCUGUC CUGAUGAGGNNNNNNNNCCGAA AAAAUUGU | 6162 |
| 3239 | CAGAGUGUA CACAAUCC | 2007 | GGAUUGUG CUGAUGAGGNNNNNNNNCCGAA ACACUCUG | 6163 |
| 3246 | UACACAAUC CAGAGUGA | 2008 | UCACUCUG CUGAUGAGGNNNNNNNNCCGAA AUUGUGUA | 6164 |
| 3258 | AGUGACGUC UGGUCUUU | 2009 | AAAGACCA CUGAUGAGGNNNNNNNNCCGAA ACGUCACU | 6165 |
| 3263 | CGUCUGGUC UUUUGGUG | 2010 | CACCAAAA CUGAUGAGGNNNNNNNNCCGAA ACCAGACG | 6166 |
| 3265 | UCUGGUCUU UUGGUGUU | 2011 | AACACCAA CUGAUGAGGNNNNNNNNCCGAA AGACCAGA | 6167 |
| 3266 | CUGGUCUUU UGGUGUUU | 2012 | AAACACCA CUGAUGAGGNNNNNNNNCCGAA AAGACCAG | 6168 |
| 3267 | UGGUCUUUU GGUGUUUU | 2013 | AAAACACC CUGAUGAGGNNNNNNNNCCGAA AAAGACCA | 6169 |
| 3273 | UUUGGUGUU UUGCUGUG | 2014 | CACAGCAA CUGAUGAGGNNNNNNNNCCGAA ACACCAAA | 6170 |
| 3274 | UUGGUGUUU UGCUGUGG | 2015 | CCACAGCA CUGAUGAGGNNNNNNNNCCGAA AACACCAA | 6171 |
| 3275 | UGGUGUUUU GCUGUGGG | 2016 | CCCACAGC CUGAUGAGGNNNNNNNNCCGAA AAACACCA | 6172 |
| 3288 | UGGGAAAUA UUUUCCUU | 2017 | AAGGAAAA CUGAUGAGGNNNNNNNNCCGAA AUUUCCCA | 6173 |
| 3290 | GGAAAUAUU UUCCUUAG | 2018 | CUAAGGAA CUGAUGAGGNNNNNNNNCCGAA AUAUUUCC | 6174 |
| 3291 | GAAAUAUUU UCCUUAGG | 2019 | CCUAAGGA CUGAUGAGGNNNNNNNNCCGAA AAUAUUUC | 6175 |
| 3292 | AAAUAUUUU CCUUAGGU | 2020 | ACCUAAGG CUGAUGAGGNNNNNNNNCCGAA AAAUAUUU | 6176 |
| 3293 | AAUAUUUUC CUUAGGUG | 2021 | CACCUAAG CUGAUGAGGNNNNNNNNCCGAA AAAAUAUU | 6177 |
| 3296 | AUUUUCCUU AGGUGCUU | 2022 | AAGCACCU CUGAUGAGGNNNNNNNNCCGAA AGGAAAAU | 6178 |
| 3297 | UUUUCCUUA GGUGCUUC | 2023 | GAAGCACC CUGAUGAGGNNNNNNNNCCGAA AAGGAAAA | 6179 |
| 3304 | UAGGUGCUU CUCCAUAU | 2024 | AUAUGGAG CUGAUGAGGNNNNNNNNCCGAA AGCACCUA | 6180 |
| 3305 | AGGUGCUUC UCCAUAUC | 2025 | GAUAUGGA CUGAUGAGGNNNNNNNNCCGAA AAGCACCU | 6181 |
| 3307 | GUGCUUCUC CAUAUCCU | 2026 | AGGAUAUG CUGAUGAGGNNNNNNNNCCGAA AGAAGCAC | 6182 |
| 3311 | UUCUCCAUA UCCUGGGG | 2027 | CCCCAGGA CUGAUGAGGNNNNNNNNCCGAA AUGGAGAA | 6183 |
| 3313 | CUCCAUAUC CUGGGGUA | 2028 | UACCCCAG CUGAUGAGGNNNNNNNNCCGAA AUAUGGAG | 6184 |
| 3321 | CCUGGGGUA AAGAUUGA | 2029 | UCAAUCUU CUGAUGAGGNNNNNNNNCCGAA ACCCCAGG | 6185 |
| 3327 | GUAAAGAUU GAUGAAGA | 2030 | UCUUCAUC CUGAUGAGGNNNNNNNNCCGAA AUCUUUAC | 6186 |
| 3338 | UGAAGAAUU UUGUAGGC | 2031 | GCCUACAA CUGAUGAGGNNNNNNNNCCGAA AUUCUUCA | 6187 |
| 3339 | GAAGAAUUU UGUAGGCG | 2032 | CGCCUACA CUGAUGAGGNNNNNNNNCCGAA AAUUCUUC | 6188 |
| 3340 | AAGAAUUUU GUAGGCGA | 2033 | UCGCCUAC CUGAUGAGGNNNNNNNNCCGAA AAAUUCUU | 6189 |
| 3343 | AAUUUUGUA GGCGAUUG | 2034 | CAAUCGCC CUGAUGAGGNNNNNNNNCCGAA ACAAAAUU | 6190 |
| 3350 | UAGGCGAUU GAAAGAAG | 2035 | CUUCUUUC CUGAUGAGGNNNNNNNNCCGAA AUCGCCUA | 6191 |
| 3364 | AAGGAACUA GAAUGAGG | 2036 | CCUCAUUC CUGAUGAGGNNNNNNNNCCGAA AGUUCCUU | 6192 |
| 3382 | CCCCUGAUU AUACUACA | 2037 | UGUAGUAU CUGAUGAGGNNNNNNNNCCGAA AUCAGGGG | 6193 |
| 3383 | CCCUGAUUA UACUACAC | 2038 | GUGUAGUA CUGAUGAGGNNNNNNNNCCGAA AAUCAGGG | 6194 |
| 3385 | CUGAUUAUA CUACACCA | 2039 | UGGUGUAG CUGAUGAGGNNNNNNNNCCGAA AUAAUCAG | 6195 |
| 3388 | AUUAUACUA CACCAGAA | 2040 | UUCUGGUG CUGAUGAGGNNNNNNNNCCGAA AGUAUAAU | 6196 |
| 3401 | AGAAAUGUA CCAGACCA | 2041 | UGGUCUGG CUGAUGAGGNNNNNNNNCCGAA ACAUUUCU | 6197 |
| 3439 | AGCCCAGUC AGAGACCC | 2042 | GGGUCUCU CUGAUGAGGNNNNNNNNCCGAA ACUGGGCU | 6198 |
| 3452 | ACCCACGUU UUCAGAGU | 2043 | ACUCUGAA CUGAUGAGGNNNNNNNNCCGAA ACGUGGGU | 6199 |
| 3453 | CCCACGUUU UCAGAGUU | 2044 | AACUCUGA CUGAUGAGGNNNNNNNNCCGAA AACGUGGG | 6200 |
| 3454 | CCACGUUUU CAGAGUUG | 2045 | CAACUCUG CUGAUGAGGNNNNNNNNCCGAA AAACGUGG | 6201 |
| 3455 | CACGUUUUC AGAGUUGG | 2046 | CCAACUCU CUGAUGAGGNNNNNNNNCCGAA AAAACGUG | 6202 |
| 3461 | UUCAGAGUU GGUGGAAC | 2047 | GUUCCACC CUGAUGAGGNNNNNNNNCCGAA ACUCUGAA | 6203 |
| 3472 | UGGAACAUU UGGGAAAU | 2048 | AUUUCCCA CUGAUGAGGNNNNNNNNCCGAA AUGUUCCA | 6204 |
| 3473 | GGAACAUUU GGGAAAUC | 2049 | GAUUUCCC CUGAUGAGGNNNNNNNNCCGAA AAUGUUCC | 6205 |
| 3481 | UGGGAAAUC UCUUGCAA | 2050 | UUGCAAGA CUGAUGAGGNNNNNNNNCCGAA AUUUCCCA | 6206 |
| 3483 | GGAAAUCUC UUGCAAGC | 2051 | GCUUGCAA CUGAUGAGGNNNNNNNNCCGAA AGAUUUCC | 6207 |
| 3485 | AAAUCUCUU GCAAGCUA | 2052 | UAGCUUGC CUGAUGAGGNNNNNNNNCCGAA AGAGAUUU | 6208 |
| 3493 | UGCAAGCUA AUGCUCAG | 2053 | CUGAGCAU CUGAUGAGGNNNNNNNNCCGAA AGCUUGCA | 6209 |
| 3499 | CUAAUGCUC AGCAGGAU | 2054 | AUCCUGCU CUGAUGAGGNNNNNNNNCCGAA AGCAUUAG | 6210 |
| 3518 | CAAAGACUA CAUUGUUC | 2055 | GAACAAUG CUGAUGAGGNNNNNNNNCCGAA AGUCUUUG | 6211 |
| 3522 | GACUACAUU GUUCUUCC | 2056 | GGAAGAAC CUGAUGAGGNNNNNNNNCCGAA AUGUAGUC | 6212 |
| 3525 | UACAUUGUU CUUCCGAU | 2057 | AUCGGAAG CUGAUGAGGNNNNNNNNCCGAA ACAAUGUA | 6213 |
| 3526 | ACAUUGUUC UUCCGAUA | 2058 | UAUCGGAA CUGAUGAGGNNNNNNNNCCGAA AACAAUGU | 6214 |
| 3528 | AUUGUUCUU CCGAUAUC | 2059 | GAUAUCGG CUGAUGAGGNNNNNNNNCCGAA AGAACAAU | 6215 |
| 3529 | UUGUUCUUC CGAUAUCA | 2060 | UGAUAUCG CUGAUGAGGNNNNNNNNCCGAA AAGAACAA | 6216 |
| 3534 | CUUCCGAUA UCAGAGAC | 2061 | GUCUCUGA CUGAUGAGGNNNNNNNNCCGAA AUCGGAAG | 6217 |
| 3536 | UCCGAUAUC AGAGACUU | 2062 | AAGUCUCU CUGAUGAGGNNNNNNNNCCGAA AUAUCGGA | 6218 |
| 3544 | CAGAGACUU UGAGCAUG | 2063 | CAUGCUCA CUGAUGAGGNNNNNNNNCCGAA AGUCUCUG | 6219 |
| 3545 | AGAGACUUU GAGCAUGG | 2064 | CCAUGCUC CUGAUGAGGNNNNNNNNCCGAA AAGUCUCU | 6220 |
| 3562 | AAGAGGAUU CUGGACUC | 2065 | GAGUCCAG CUGAUGAGGNNNNNNNNCCGAA AUCCUCUU | 6221 |
| 3563 | AGAGGAUUC UGGACUCU | 2066 | AGAGUCCA CUGAUGAGGNNNNNNNNCCGAA AAUCCUCU | 6222 |
| 3570 | UCUGGACUC UCUCUGCC | 2067 | GGCAGAGA CUGAUGAGGNNNNNNNNCCGAA AGUCCAGA | 6223 |
| 3572 | UGGACUCUC UCUGCCUA | 2068 | UAGGCAGA CUGAUGAGGNNNNNNNNCCGAA AGAGUCCA | 6224 |
| 3574 | GACUCUCUC UGCCUACC | 2069 | GGUAGGCA CUGAUGAGGNNNNNNNNCCGAA AGAGAGUC | 6225 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 3580 | CUCUGCCUA CCUCACCU | 2070 | AGGUGAGG CUGAUGAGGNNNNNNNNCCGAA AGGCAGAG | 6226 |
| 3584 | GCCUACCUC ACCUGUUU | 2071 | AAACAGGU CUGAUGAGGNNNNNNNNCCGAA AGGUAGGC | 6227 |
| 3591 | UCACCUGUU UCCUGUAU | 2072 | AUACAGGA CUGAUGAGGNNNNNNNNCCGAA ACAGGUGA | 6228 |
| 3592 | CACCUGUUU CCUGUAUG | 2073 | CAUACAGG CUGAUGAGGNNNNNNNNCCGAA AACAGGUG | 6229 |
| 3593 | ACCUGUUUC CUGUAUGG | 2074 | CCAUACAG CUGAUGAGGNNNNNNNNCCGAA AAACAGGU | 6230 |
| 3598 | UUUCCUGUA UGGAGGAG | 2075 | CUCCUCCA CUGAUGAGGNNNNNNNNCCGAA ACAGGAAA | 6231 |
| 3615 | GAGGAAGUA UGUGACCC | 2076 | GGGUCACA CUGAUGAGGNNNNNNNNCCGAA ACUUCCUC | 6232 |
| 3629 | CCCCAAAUU CCAUUAUG | 2077 | CAUAAUGG CUGAUGAGGNNNNNNNNCCGAA AUUGGGG | 6233 |
| 3630 | CCCAAAUUC CAUUAUGA | 2078 | UCAUAAUG CUGAUGAGGNNNNNNNNCCGAA AAUUUGGG | 6234 |
| 3634 | AAUUCCAUU AUGACAAC | 2079 | GUUGUCAU CUGAUGAGGNNNNNNNNCCGAA AUGGAAUU | 6235 |
| 3653 | AUUCCAUUA UGACAACA | 2080 | UGUUGUCA CUGAUGAGGNNNNNNNNCCGAA AAUGGAAU | 6236 |
| 3654 | GCAGGAAUC AGUCAGUA | 2081 | UACUGACU CUGAUGAGGNNNNNNNNCCGAA AUUCCUGC | 6237 |
| 3658 | GAAUCAGUC AGUAUCUG | 2082 | CAGAUACU CUGAUGAGGNNNNNNNNCCGAA ACUGAUUC | 6238 |
| 3662 | CAGUCAGUA UCUGCAGA | 2083 | UCUGCAGA CUGAUGAGGNNNNNNNNCCGAA ACUGACUG | 6239 |
| 3664 | GUCAGUAUC UGCAGAAC | 2084 | GUUCUGCA CUGAUGAGGNNNNNNNNCCGAA AUACUGAC | 6240 |
| 3676 | AGAACAGUA AGCGAAAG | 2085 | CUUUCGCU CUGAUGAGGNNNNNNNNCCGAA ACUGUUCU | 6241 |
| 3702 | GUGAGUGUA AAAACAUU | 2086 | AAUGUUUU CUGAUGAGGNNNNNNNNCCGAA ACACUCAC | 6242 |
| 3710 | AAAAACAUU UGAAGAUA | 2087 | UAUCUUCA CUGAUGAGGNNNNNNNNCCGAA AUGUUUUU | 6243 |
| 3711 | AAAACAUUU GAAGAUAU | 2088 | AUAUCUUC CUGAUGAGGNNNNNNNNCCGAA AAUGUUUU | 6244 |
| 3718 | UUGAAGAUA UCCCGUUA | 2089 | UAACGGGA CUGAUGAGGNNNNNNNNCCGAA AUCUUCAA | 6245 |
| 3720 | GAAGAUAUC CCGUUAGA | 2090 | UCUAACGG CUGAUGAGGNNNNNNNNCCGAA AUAUCUUC | 6246 |
| 3725 | UAUCCCGUU AGAAGAAC | 2091 | GUUCUUCU CUGAUGAGGNNNNNNNNCCGAA ACGGGAUA | 6247 |
| 3726 | AUCCCGUUA GAAGAACC | 2092 | GGUUCUUC CUGAUGAGGNNNNNNNNCCGAA AACGGGAU | 6248 |
| 3741 | CCAGAAGUA AAAGUAAU | 2093 | AUUACUUU CUGAUGAGGNNNNNNNNCCGAA ACUUCUGG | 6249 |
| 3747 | GUAAAAGUA AUCCCAGA | 2094 | UCUGGGAU CUGAUGAGGNNNNNNNNCCGAA ACUUUUAC | 6250 |
| 3750 | AAAGUAAUC CCAGAUGA | 2095 | UCAUCUGG CUGAUGAGGNNNNNNNNCCGAA AUUACUUU | 6251 |
| 3778 | ACAGUGGUA UGGUUCUU | 2096 | AAGAACCA CUGAUGAGGNNNNNNNNCCGAA ACCACUGU | 6252 |
| 3783 | GGUAUGGUU CUUGCCUC | 2097 | GAGGCAAG CUGAUGAGGNNNNNNNNCCGAA ACCAUACC | 6253 |
| 3784 | GUAUGGUUC UUGCCUCA | 2098 | UGAGGCAA CUGAUGAGGNNNNNNNNCCGAA AACCAUAC | 6254 |
| 3786 | AUGGUUCUU GCCUCAGA | 2099 | UCUGAGGC CUGAUGAGGNNNNNNNNCCGAA AGAACCAU | 6255 |
| 3791 | UCUUGCCUC AGAAGAGC | 2100 | GCUCUUCU CUGAUGAGGNNNNNNNNCCGAA AGGCAAGA | 6256 |
| 3808 | UGAAAACUU UGGAAGAC | 2101 | GUCUUCCA CUGAUGAGGNNNNNNNNCCGAA AGUUUUCA | 6257 |
| 3809 | GAAAACUUU GGAAGACA | 2102 | UGUCUUCC CUGAUGAGGNNNNNNNNCCGAA AAGUUUUC | 6258 |
| 3827 | AACCAAAUU AUCUCCAU | 2103 | AUGGAGAU CUGAUGAGGNNNNNNNNCCGAA AUUUGGUU | 6259 |
| 3828 | ACCAAAUUA UCUCCAUC | 2104 | GAUGGAGA CUGAUGAGGNNNNNNNNCCGAA AAUUUGGU | 6260 |
| 3830 | CAAAUUAUC UCCAUCUU | 2105 | AAGAUGGA CUGAUGAGGNNNNNNNNCCGAA AUAAUUUG | 6261 |
| 3832 | AAUUAUCUC CAUCUUUU | 2106 | AAAAGAUG CUGAUGAGGNNNNNNNNCCGAA AGAUAAUU | 6262 |
| 3836 | AUCUCCAUC UUUUGGUG | 2107 | CACCAAAA CUGAUGAGGNNNNNNNNCCGAA AUGGAGAU | 6263 |
| 3838 | CUCCAUCUU UUGGUGGA | 2108 | UCCACCAA CUGAUGAGGNNNNNNNNCCGAA AGAUGGAG | 6264 |
| 3839 | UCCAUCUUU UGGUGGAA | 2109 | UUCCACCA CUGAUGAGGNNNNNNNNCCGAA AAGAUGGA | 6265 |
| 3840 | CCAUCUUUU GGUGGAAU | 2110 | AUUCCACC CUGAUGAGGNNNNNNNNCCGAA AAAGAUGG | 6266 |
| 3872 | CAGGGAGUC UGUGGCAU | 2111 | AUGCCACA CUGAUGAGGNNNNNNNNCCGAA ACUCCCUG | 6267 |
| 3881 | UGUGGCAUC UGAAGGCU | 2112 | AGCCUUCA CUGAUGAGGNNNNNNNNCCGAA AUGCCACA | 6268 |
| 3890 | UGAAGGCUC AAACCAGA | 2113 | UCUGGUUU CUGAUGAGGNNNNNNNNCCGAA AGCCUUCA | 6269 |
| 3908 | AAGCGGCUA CCAGUCCG | 2114 | CGGACUGG CUGAUGAGGNNNNNNNNCCGAA AGCCGCUU | 6270 |
| 3914 | CUACCAGUC GGAUAUC | 2115 | GAUAUCCG CUGAUGAGGNNNNNNNNCCGAA ACUGGUAG | 6271 |
| 3920 | GUCCGGAUA UCACUCCG | 2116 | CGGAGUGA CUGAUGAGGNNNNNNNNCCCAA AUCCGGAC | 6272 |
| 3922 | CCGGAUAUC ACUCCGAU | 2117 | AUCGGAGU CUGAUGAGGNNNNNNNNCCGAA AUAUCCGG | 6273 |
| 3926 | AUAUCACUC CGAUGACA | 2118 | UGUCAUCG CUGAUGAGGNNNNNNNNCCCAA AGUGAUAU | 6274 |
| 3950 | CACCGUGUA CUCCAGUG | 2119 | CACUGGAG CUGAUGAGGNNNNNNNNCCGAA ACACGGUG | 6275 |
| 3953 | CGUGUACUC CAGUGAGG | 2120 | CCUCACUG CUGAUGAGGNNNNNNNNCCGAA AGUACACG | 6276 |
| 3972 | GCAGAACUU UUAAAGCU | 2121 | AGCUUUAA CUGAUGAGGNNNNNNNNCCGAA AGUUCUGC | 6277 |
| 3973 | CAGAACUUU UAAAGCUG | 2122 | CAGCUUUA CUGAUGAGGNNNNNNNNCCGAA AAGUUCUG | 6278 |
| 3974 | AGAACUUUU AAAGCUGA | 2123 | UCAGCUUU CUGAUGAGGNNNNNNNNCCGAA AAAGUUCU | 6279 |
| 3975 | GAACUUUUA AAGCUGAU | 2124 | AUCAGCUU CUGAUGAGGNNNNNNNNCCGAA AAAAGUUC | 6280 |
| 3984 | AAGCUGAUA GAGAUUGG | 2125 | CCAAUCUC CUGAUGAGGNNNNNNNNCCGAA AUCAGCUU | 6281 |
| 3990 | AUAGAGAUU GGAGUGCA | 2126 | UGCACUCC CUGAUGAGGNNNNNNNNCCGAA AUCUCUAU | 6282 |
| 4006 | AAACCGGUA GCACAGCC | 2127 | GGCUGUGC CUGAUGAGGNNNNNNNNCCGAA ACCGGUUU | 6283 |
| 4020 | GCCCAGAUU CUCCAGCC | 2128 | GGCUGGAG CUGAUGAGGNNNNNNNNCCGAA AUCUGGGC | 6284 |
| 4021 | CCCAGAUUC UCCAGCCU | 2129 | AGGCUGGA CUGAUGAGGNNNNNNNNCCGAA AAUCUGGG | 6285 |
| 4023 | CAGAUUCUC CAGCUGA | 2130 | UCAGGCUG CUGAUGAGGNNNNNNNNCCGAA AGAAUCUG | 6286 |
| 4052 | ACUGAGCUC UCCUCCUG | 2131 | CAGGAGGA CUGAUGAGGNNNNNNNNCCGAA AGCUCAGU | 6287 |
| 4054 | UGAGCUCUC CUCCUGUU | 2132 | AACAGGAG CUGAUGAGGNNNNNNNNCCGAA AGAGCUCA | 6288 |
| 4057 | GCUCUCCUC CUGUUUAA | 2133 | UUAAACAG CUGAUGAGGNNNNNNNNCCGAA AGGAGAGC | 6289 |
| 4062 | CCUCCUGUU UAAAAGGA | 2134 | UCCUUUUA CUGAUGAGGNNNNNNNNCCGAA ACAGGAGG | 6290 |
| 4063 | CUCCUGUUU AAAAGGAA | 2135 | UUCCUUUU CUGAUGAGGNNNNNNNNCCGAA AACAGGAG | 6291 |
| 4064 | UCCUGUUUA AAAGGAAG | 2136 | CUUCCUUU CUGAUGAGGNNNNNNNNCCGAA AAACAGGA | 6292 |
| 4076 | GGAAGCAUC CACACCCC | 2137 | GGGGUGUG CUGAUGAGGNNNNNNNNCCGAA AUGCUUCC | 6293 |
| 4089 | CCCCAACUC CCGGACAU | 2138 | AUGUCCGG CUGAUGAGGNNNNNNNNCCGAA AGUUGGGG | 6294 |
| 4098 | CCGGACAUC ACAUGAGA | 2139 | UCUCAUGU CUGAUGAGGNNNNNNNNCCGAA AUGUCCGG | 6295 |
| 4110 | UGAGAGGUC UGCUCAGA | 2140 | UCUGAGCA CUGAUGAGGNNNNNNNNCCGAA ACCUCUCA | 6296 |
| 4115 | GGUCUGCUC AGAUUUUG | 2141 | CAAAAUCU CUGAUGAGGNNNNNNNNCCGAA AGCAGACC | 6297 |
| 4120 | GCUCAGAUU UUGAAGUG | 2142 | CACUUCAA CUGAUGAGGNNNNNNNNCCGAA AUCUGAGC | 6298 |

TABLE IV-continued

Human KDR VEGF Receptor-Hammerhead Ribozyme and Substrate Sequence

| Pos | Substrate | Seq ID No | HH Ribozyme Sequence | Seq ID No |
|---|---|---|---|---|
| 4121 | CUCAGAUUU UGAAGUGU | 2143 | ACACUUCA CUGAUGAG<u>GNNNNNNNN</u>CCGAA AAUCUGAG | 6299 |
| 4122 | UCAGAUUUU GAAGUGUU | 2144 | AACACUUC CUGAUGAG<u>GNNNNNNNN</u>CCGAA AAAUCUGA | 6300 |
| 4130 | UGAAGUGUU GUUCUUUC | 2145 | GAAAGAAC CUGAUGAG<u>GNNNNNNNN</u>CCGAA ACACUUCA | 6301 |
| 4133 | AGUGUUGUU CUUUCCAC | 2146 | GUGGAAAG CUGAUGAG<u>GNNNNNNNN</u>CCGAA ACAACACU | 6302 |
| 4134 | GUGUUGUUC UUUCCACC | 2147 | GGUGGAAA CUGAUGAG<u>GNNNNNNNN</u>CCGAA AACAACAC | 6303 |
| 4136 | GUUGUUCUU UCCACCAG | 2148 | CUGGUGGA CUGAUGAG<u>GNNNNNNNN</u>CCGAA AGAACAAC | 6304 |
| 4137 | UUGUUCUUU CCACCAGC | 2149 | GCUGGUGG CUGAUGAG<u>GNNNNNNNN</u>CCGAA AAGAACAA | 6305 |
| 4138 | UGUUCUUUC CACCAGCA | 2150 | UGCUGGUG CUGAUGAG<u>GNNNNNNNN</u>CCGAA AAAGAACA | 6306 |
| 4153 | CAGGAAGUA GCCGCAUU | 2151 | AAUGCGGC CUGAUGAG<u>GNNNNNNNN</u>CCGAA ACUUCCUG | 6307 |
| 4161 | AGCCGCAUU UGAUUUUC | 2152 | GAAAAUCA CUGAUGAG<u>GNNNNNNNN</u>CCGAA AAUGCGGCU | 6308 |
| 4162 | GCCGCAUUU GAUUUUCA | 2153 | UGAAAAUC CUGAUGAG<u>GNNNNNNNN</u>CCGAA AAUGCGGC | 6309 |
| 4166 | CAUUUGAUU UUCAUUUC | 2154 | GAAAUGAA CUGAUGAG<u>GNNNNNNNN</u>CCGAA AUCAAAUG | 6310 |
| 4167 | AUUUGAUUU UCAUUUCG | 2155 | CGAAAUGA CUGAUGAG<u>GNNNNNNNN</u>CCGAA AAUCAAAU | 6311 |
| 4168 | UUUGAUUUU CAUUUCGA | 2156 | UCGAAAUG CUGAUGAG<u>GNNNNNNNN</u>CCGAA AAAUCAAA | 6312 |
| 4169 | UUGAUUUUC AUUUCGAC | 2157 | GUCGAAAU CUGAUGAG<u>GNNNNNNNN</u>CCGAA AAAAUCAA | 6313 |
| 4172 | AUUUUCAUU UCGACAAC | 2158 | GUUGUCGA CUGAUGAG<u>GNNNNNNNN</u>CCGAA AUGAAAAU | 6314 |
| 4173 | UUUUCAUUU CGACAACA | 2159 | UGUUGUCG CUGAUGAG<u>GNNNNNNNN</u>CCGAA AAUGAAAA | 6315 |
| 4174 | UUUCAUUUC GACAACAG | 2160 | CUGUUGUC CUGAUGAG<u>GNNNNNNNN</u>CCGAA AAAUGAAA | 6316 |
| 4194 | AAGGACCUC GGACUGCA | 2161 | UGCAGUCC CUGAUGAG<u>GNNNNNNNN</u>CCGAA AGGUCCUU | 6317 |
| 4214 | AGCCAGCUC UUCUAGGC | 2162 | GCCUAGAA CUGAUGAG<u>GNNNNNNNN</u>CCGAA AGCUGGCU | 6318 |
| 4216 | CCAGCUCUU CUAGGCUU | 2163 | AAGCCUAG CUGAUGAG<u>GNNNNNNNN</u>CCGAA AGAGCUGG | 6319 |
| 4217 | CAGCUCUUC UAGGCUUG | 2164 | CAAGCCUA CUGAUGAG<u>GNNNNNNNN</u>CCGAA AAGAGCUG | 6320 |
| 4219 | GCUCUUCUA GGCUUGUG | 2165 | CACAAGCC CUGAUGAG<u>GNNNNNNNN</u>CCGAA AGAAGAGC | 6321 |

Where "X" represents stem II region of a HH ribozyme (Hertel et al., 1992 Nucleic Acids Res. 20 3252). The length of stem II may be >2 base-pairs.
Underlined region can be any X sequence or linker, as described herein.

TABLE V

Human KDR VEGF Receptor-Hairpin Ribozyme and Substrate Sequences

| Pos | Substrate | Seq ID No | HP Ribozyme Sequence | Seq ID No |
|---|---|---|---|---|
| 11 | AGGUGCU GCU GGCCGUCG | 2166 | CGACGGCC AGAA GCACCU ACCAGAGAAACACACGUUGUGGUACAUUACCUGGUA | 6322 |
| 18 | GCUGGCC GUC GCCCUGUG | 2167 | CACAGGGC AGAA GCCAGC ACCAGAGAAACACACGUUGUGGUACAUUACCUGGUA | 6323 |
| 51 | CCGGGCC GCC UCUGUGGG | 2168 | CCCACAGA AGAA GCCCGG ACCAGAGAAACACACGUUGUGGUACAUUACCUGGUA | 6324 |
| 86 | UUGAUCU GCC CAGGCUCA | 2169 | UGAGCCUG AGAA GAUCAA ACCAGAGAAACACACGUUGUGGUACAUUACCUGGUA | 6325 |
| 318 | GGAAACU GAC UUGGCCUC | 2170 | GAGGCCAA AGAA GUUUCC ACCAGAGAAACACACGUUGUGGUACAUUACCUGGUA | 6326 |
| 358 | GAUUACA GAU CUCCAUUU | 2171 | AAAUGGAG AGAA GUAAUC ACCAGAGAAACACACGUUGUGGUACAUUACCUGGUA | 6327 |
| 510 | UGUUCCU GAU GGUAACAG | 2172 | CUGUUACC AGAA GGAACA ACCAGAGAAACACACGUUGUGGUACAUUACCUGGUA | 6328 |
| 623 | GUUACCA GUC UAUUAUGU | 2173 | ACAUAAUA AGAA GGUAAC ACCAGAGAAACACACGUUGUGGUACAUUACCUGGUA | 6329 |
| 683 | UGAGUCC GUC UCAUGGAA | 2174 | UUCCAUGA AGAA GACUCA ACCAGAGAAACACACGUUGUGGUACAUUACCUGGUA | 6330 |
| 705 | ACUAUCU GUU GGAGAAAA | 2175 | UUUUCUCC AGAA GAUAGU ACCAGAGAAACACACGUUGUGGUACAUUACCUGGUA | 6331 |
| 833 | AAACCCA GUC UGGGAGUG | 2176 | CACUCCCA AGAA GGGUUU ACCAGAGAAACACACGUUGUGGUACAUUACCUGGUA | 6332 |
| 932 | GUGGGCU GAU GACCAAGA | 2177 | UCUUGGUC AGAA GCCCAC ACCAGAGAAACACACGUUGUGGUACAUUACCUGGUA | 6333 |
| 1142 | AUGUACU GAC GAUUAUGG | 2178 | CCAUAAUC AGAA GUACAU ACCAGAGAAACACACGUUGUGGUACAUUACCUGGUA | 6334 |
| 1259 | CACCCCA GAU UGGUGAGA | 2179 | UCUCACCA AGAA GGGGUG ACCAGAGAAACACACGUUGUGGUACAUUACCUGGUA | 6335 |
| 1332 | AUGUACG GUC UAUGCCAU | 2180 | AUGGCAUA AGAA GUACAU ACCAGAGAAACACACGUUGUGGUACAUUACCUGGUA | 6336 |
| 1376 | AUUGGCA GUU GGAGGAAG | 2181 | CUUCCUCC AGAA GCCAAU ACCAGAGAAACACACGUUGUGGUACAUUACCUGGUA | 6337 |
| 1413 | CCAAGCU GUC UCAGUGAC | 2182 | GUCACUGA AGAA GCUUGG ACCAGAGAAACACACGUUGUGGUACAUUACCUGGUA | 6338 |
| 1569 | UGUGUCA GCU UUGUACAA | 2183 | UUGUACAA AGAA GACACA ACCAGAGAAACACACGUUGUGGUACAUUACCUGGUA | 6339 |
| 1673 | ACAUGCA GCC CACUGAGC | 2184 | GCUCAGUG AGAA GCAUGU ACCAGAGAAACACACGUUGUGGUACAUUACCUGGUA | 6340 |
| 1717 | GCAGACA GAU CUACGUUU | 2185 | AAACGUAG AGAA GUCUGC ACCAGAGAAACACACGUUGUGGUACAUUACCUGGUA | 6341 |
| 1760 | GCCCACA GCC UCUGCCAA | 2186 | UUGGCAGA AGAA GUGGGC ACCAGAGAAACACACGUUGUGGUACAUUACCUGGUA | 6342 |
| 1797 | CACACCU GUU UGCAAGAA | 2187 | UUCUUGCA AGAA GGUGUG ACCAGAGAAACACACGUUGUGGUACAUUACCUGGUA | 6343 |
| 1918 | UAUGUCU GCC UUGCUCAA | 2188 | UUGAGCAA AGAA GACAUA ACCAGAGAAACACACGUUGUGGUACAUUACCUGGUA | 6344 |
| 1967 | UCAGGCA GCU CACAGUCC | 2189 | GGACUGUG AGAA GCCUGA ACCAGAGAAACACACGUUGUGGUACAUUACCUGGUA | 6345 |
| 1974 | GCUCACA GUC CUAGAGCG | 2190 | CGCUCUAG AGAA GUGAGC ACCAGAGAAACACACGUUGUGGUACAUUACCUGGUA | 6346 |
| 2021 | AGAAUCA GAC GACAAGUA | 2191 | UACUUGUC AGAA GAUUCU ACCAGAGAAACACACGUUGUGGUACAUUACCUGGUA | 6347 |
| 2084 | CUCCACA GAU CAUGUGGU | 2192 | ACCACAUG AGAA GUGGAG ACCAGAGAAACACACGUUGUGGUACAUUACCUGGUA | 6348 |
| 2418 | GGAUCCA GAU GAACUCCC | 2193 | GGGAGUUC AGAA GGAUCC ACCAGAGAAACACACGUUGUGGUACAUUACCUGGUA | 6349 |
| 2453 | AACGACU GCC UUAUGAUG | 2194 | CAUCAUAA AGAA GUCGUU ACCAGAGAAACACACGUUGUGGUACAUUACCUGGUA | 6350 |
| 2492 | GAGACCG GCU GAACCUAG | 2195 | CUAGGUUC AGAA GGUCUC ACCAGAGAAACACACGUUGUGGUACAUUACCUGGUA | 6351 |
| 2547 | UGAAGCA GAU GCCUUUGG | 2196 | CCAAAGGC AGAA GCUUCA ACCAGAGAAACACACGUUGUGGUACAUUACCUGGUA | 6352 |
| 2765 | GAAACCU GUC CACUUACC | 2197 | GGUAAGUG AGAA GGUUUC ACCAGAGAAACACACGUUGUGGUACAUUACCUGGUA | 6353 |
| 2914 | UCAGCCA GCU CUGGAUUU | 2198 | AAAUCCAG AGAA GGCUGA ACCAGAGAAACACACGUUGUGGUACAUUACCUGGUA | 6354 |
| 2993 | ACUUCCU GAC CUUGGAGC | 2199 | GCUCCAAG AGAA GGAAGU ACCAGAGAAACACACGUUGUGGUACAUUACCUGGUA | 6355 |
| 3019 | UGUUACA GCU UCCAAGUG | 2200 | CACUUGGA AGAA GUAACA ACCAGAGAAACACACGUUGUGGUACAUUACCUGGUA | 6356 |

TABLE V-continued

Human KDR VEGF Receptor-Hairpin Ribozyme and Substrate Sequences

| Pos | Substrate | Seq ID No | HP Ribozyme Sequence | Seq ID No |
|---|---|---|---|---|
| 3165 | AGAUCCA GAU UAUGUCAG | 2201 | CUGACAUA AGAA GGAUCU ACCAGAGAAACACACGUUGUGGUACAUUACCUGGUA | 6357 |
| 3378 | GGCCCCU GAU UAUACUAC | 2202 | GUAGUAUA AGAA GGGGCC ACCAGAGAAACACACGUUGUGGUACAUUACCUGGUA | 6358 |
| 3404 | UGUACCA GAC CAUGCUGG | 2203 | CCAGCAUG AGAA GGUACA ACCAGAGAAACACACGUUGUGGUACAUUACCUGGUA | 6359 |
| 3418 | CUGGACU GCU GGCACGGG | 2204 | CCCGUGCC AGAA GUCCAG ACCAGAGAAACACACGUUGUGGUACAUUACCUGGUA | 6360 |
| 3575 | UCUCUCU GCC UACCUCAC | 2205 | GUGAGGUA AGAA GAGAGA ACCAGAGAAACACACGUUGUGGUACAUUACCUGGUA | 6361 |
| 3588 | CUCACCU GUU UCCUGUAU | 2206 | AUACAGGA AGAA GGUGAG ACCAGAGAAACACACGUUGUGGUACAUUACCUGGUA | 6362 |
| 3689 | AGAGCCG GCC UGUGAGUG | 2207 | CACUCACA AGAA GGCUCU ACCAGAGAAACACACGUUGUGGUACAUUACCUGGUA | 6363 |
| 3753 | AAUCCCA GAU GACAACCA | 2208 | UGGUUGUC AGAA GGGAUU ACCAGAGAAACACACGUUGUGGUACAUUACCUGGUA | 6364 |
| 3764 | ACAACCA GAC GGACAGUG | 2209 | CACUGUCC AGAA GGUUGU ACCAGAGAAACACACGUUGUGGUACAUUACCUGGUA | 6365 |
| 3911 | GCUACCA GUC CGGAUAUC | 2210 | GAUAUCCG AGAA GGUAGC ACCAGAGAAACACACGUUGUGGUACAUUACCUGGUA | 6366 |
| 3927 | UCACUCC GAU GACACAGA | 2211 | UCUGUGUC AGAA GAGUGA ACCAGAGAAACACACGUUGUGGUACAUUACCUGGUA | 6367 |
| 4011 | UAGCACA GCC CAGAUUCU | 2212 | AGAAUCUG AGAA GUGCUA ACCAGAGAAACACACGUUGUGGUACAUUACCUGGUA | 6368 |
| 4016 | CAGCCCA GAU UCUCCAGC | 2213 | GCUGGAGA AGAA GGGCUG ACCAGAGAAACACACGUUGUGGUACAUUACCUGGUA | 6369 |
| 4025 | UUCUCCA GCC UGACACGG | 2214 | CCGUGUCA AGAA GGAGAA ACCAGAGAAACACACGUUGUGGUACAUUACCUGGUA | 6370 |
| 4059 | UCCUCCU GUU UAAAGGA | 2215 | UCCUUUUA AGAA GGAGGA ACCAGAGAAACACACGUUGUGGUACAUUACCUGGUA | 6371 |
| 4111 | GAGGUCU GCU CAGAUUUU | 2216 | AAAAUCUG AGAA GACCUC ACCAGAGAAACACACGUUGUGGUACAUUACCUGGUA | 6372 |
| 4116 | CUGCUCA GAU UUUGAAGU | 2217 | ACUUCAAA AGAA GAGCAG ACCAGAGAAACACACGUUGUGGUACAUUACCUGGUA | 6373 |
| 4195 | GACCUCG GAC UGCAGGGA | 2218 | UCCCUGCA AGAA GAGGUC ACCAGAGAAACACACGUUGUGGUACAUUACCUGGUA | 6374 |
| 4210 | GGAGCCA GCU CUUCUAGG | 2219 | CCUAGAAG AGAA GGCUCC ACCAGAGAAACACACGUUGUGGUACAUUACCUGGUA | 6375 |

TABLE VI

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 13 | GGGCGAAUU GGGUACGG | 2220 | CCGUACCC CUGAUGAGGNNNNNNNNCCGAA AUUCGCCC | 6376 |
| 18 | AAUUGGGUA CGGGACCC | 2221 | GGGUCCCG CUGAUGAGGNNNNNNNNCCGAA ACCCAAUU | 6377 |
| 31 | ACCCCCUC GAGGUCGA | 2222 | UCGACCUC CUGAUGAGGNNNNNNNNCCGAA AGGGGGGU | 6378 |
| 37 | CUCGAGGUC GACGGUAU | 2223 | AUACCGUC CUGAUGAGGNNNNNNNNCCGAA ACCUCGAG | 6379 |
| 44 | UCGACGGUA UCGAUAAG | 2224 | CUUAUCGA CUGAUGAGGNNNNNNNNCCGAA ACCGUCGA | 6380 |
| 46 | GACGGUAUC GAUAAGCU | 2225 | AGCUUAUC CUGAUGAGGNNNNNNNNCCGAA AUACCGUC | 6381 |
| 50 | GUAUCGAUA AGCUUGAU | 2226 | AUCAAGCU CUGAUGAGGNNNNNNNNCCGAA AUCGAUAC | 6382 |
| 55 | GAUAAGCUU GAUAUCGA | 2227 | UCGAUAUC CUGAUGAGGNNNNNNNNCCGAA AGCUUAUC | 6383 |
| 59 | AGCUUGAUA UCGAAUUC | 2228 | GAAUUCGA CUGAUGAGGNNNNNNNNCCGAA AUCAAGCU | 6384 |
| 61 | CUUGAUAUC GAAUUCGG | 2229 | CCGAAUUC CUGAUGAGGNNNNNNNNCCGAA AUAUCAAG | 6385 |
| 66 | UAUCGAAUU CGGGCCCA | 2230 | UGGGCCCG CUGAUGAGGNNNNNNNNCCGAA AUUCGAUA | 6386 |
| 67 | AUCGAAUUC GGGCCCAG | 2231 | CUGGGCCC CUGAUGAGGNNNNNNNNCCGAA AAUUCGAU | 6387 |
| 83 | GACUGUGUC CCGCAGCC | 2232 | GGCUGCGG CUGAUGAGGNNNNNNNNCCGAA ACACAGUC | 6388 |
| 97 | GCCGGGAUA ACCUGGCU | 2233 | AGCCAGGU CUGAUGAGGNNNNNNNNCCGAA AUCCCGGC | 6389 |
| 114 | GACCCGAUU CCGCGGAC | 2234 | GUCCGCGG CUGAUGAGGNNNNNNNNCCGAA AUCGGGUC | 6390 |
| 115 | ACCCGAUUC CGCGGACA | 2235 | UGUCCGCG CUGAUGAGGNNNNNNNNCCGAA AAUCGGGU | 6391 |
| 169 | CCCGCGCUC UCCCCGGU | 2236 | ACCGGGGA CUGAUGAGGNNNNNNNNCCGAA AGCGCGGG | 6392 |
| 171 | CGCGCUCUC CCCGGUCU | 2237 | AGACCGGG CUGAUGAGGNNNNNNNNCCGAA AGAGCGCG | 6393 |
| 178 | UCCCCGGUC UUGCGCUG | 2238 | CAGCGCAA CUGAUGAGGNNNNNNNNCCGAA ACCGGGGA | 6394 |
| 180 | CCCGGUCUU GCGCUGCG | 2239 | CGCAGCGC CUGAUGAGGNNNNNNNNCCGAA AGACCGGG | 6395 |
| 197 | GGGGCCAUA CCGCCUCU | 2240 | AGAGGCGG CUGAUGAGGNNNNNNNNCCGAA AUGGCCCC | 6396 |
| 204 | UACCGCCUC UGUGACUU | 2241 | AAGUCACA CUGAUGAGGNNNNNNNNCCGAA AGGCGGUA | 6397 |
| 212 | CUGUGACUU CUUUGCGG | 2242 | CCGCAAAG CUGAUGAGGNNNNNNNNCCGAA AGUCACAG | 6398 |
| 213 | UGUGACUUC UUUGCGGG | 2243 | CCCGCAAA CUGAUGAGGNNNNNNNNCCGAA AAGUCACA | 6399 |
| 215 | UGACUUCUU UGCGGGCC | 2244 | GGCCCGCA CUGAUGAGGNNNNNNNNCCGAA AGAAGUCA | 6400 |
| 216 | GACUUCUUU GCGGGCCA | 2245 | UGGCCCGC CUGAUGAGGNNNNNNNNCCGAA AAGAAGUC | 6401 |
| 241 | GAAGGAGUC UGUGCCUG | 2246 | CAGGCACA CUGAUGAGGNNNNNNNNCCGAA ACUCCUUC | 6402 |
| 262 | ACUGGGCUC UGUGCCCA | 2247 | UGGGCACA CUGAUGAGGNNNNNNNNCCGAA AGCCCAGU | 6403 |
| 306 | GCGCUGCUA GCUGUCGC | 2248 | GCGACAGC CUGAUGAGGNNNNNNNNCCGAA AGCAGCGC | 6404 |
| 312 | CUAGCUGUC GCUCUGUG | 2249 | CACAGAGC CUGAUGAGGNNNNNNNNCCGAA ACAGCUAG | 6405 |
| 316 | CUGUCGCUC UGUGGUUC | 2250 | GAACCACA CUGAUGAGGNNNNNNNNCCGAA AGCGACAG | 6406 |
| 323 | UCUGUGGUU CUGCGUGG | 2251 | CCACGCAG CUGAUGAGGNNNNNNNNCCGAA ACCACAGA | 6407 |
| 324 | CUGUGGUUC UGCGUGGA | 2252 | UCCACGCA CUGAUGAGGNNNNNNNNCCGAA AACCACAG | 6408 |
| 347 | AGCCGCCUC UGUGGGUU | 2253 | AACCCACA CUGAUGAGGNNNNNNNNCCGAA AGGCGGCU | 6409 |
| 355 | CUGUGGGUU UGACUGGC | 2254 | GCCAGUCA CUGAUGAGGNNNNNNNNCCGAA ACCCACAG | 6410 |
| 356 | UGUGGGUUU GACUGGCG | 2255 | CGCCAGUC CUGAUGAGGNNNNNNNNCCGAA AACCCACA | 6411 |
| 367 | CUGGCGAUU UUCCAUCCAU | 2256 | AUGGAGAA CUGAUGAGGNNNNNNNNCCGAA AUCGCCAG | 6412 |
| 368 | UGGCGAUUU UCCAUCUC | 2257 | GAUGGAGA CUGAUGAGGNNNNNNNNCCGAA AAAUCGCCA | 6413 |
| 369 | GGCGAUUUU CUCCAUCC | 2258 | GGAUGGAG CUGAUGAGGNNNNNNNNCCGAA AAAUCGCC | 6414 |
| 370 | GCGAUUUUC UCCAUCCC | 2259 | GGGAUGGA CUGAUGAGGNNNNNNNNCCGAA AAAAUCGC | 6415 |
| 372 | GAUUUUCUC CAUCCCCC | 2260 | GGGGGAUG CUGAUGAGGNNNNNNNNCCGAA AGAAAAUC | 6416 |
| 376 | UUCUCCAUC CCCCAAG | 2261 | CUUGGGGG CUGAUGAGGNNNNNNNNCCGAA AUGGAGAA | 6417 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 387 | CCCAAGCUC AGCACACA | 2262 | UGUGUGCU CUGAUGAGGNNNNNNNNCCGAA AGCUUGGG | 6418 |
| 405 | AAAGACAUA CUGACAAU | 2263 | AUUGUCAG CUGAUGAGGNNNNNNNNCCGAA AUGUCUUU | 6419 |
| 414 | CUGACAAUU UUGGCAAA | 2264 | UUUGCCAA CUGAUGAGGNNNNNNNNCCGAA AUUGUCAG | 6420 |
| 415 | UGACAAUUU UGGCAAAU | 2265 | AUUUGCCA CUGAUGAGGNNNNNNNNCCGAA AAUUGUCA | 6421 |
| 416 | GACAAUUUU GGCAAAUA | 2266 | UAUUUGCC CUGAUGAGGNNNNNNNNCCGAA AAAUUGUC | 6422 |
| 424 | UGGCAAAUA CAACCCUU | 2267 | AAGGGUUG CUGAUGAGGNNNNNNNNCCGAA AUUUGCCA | 6423 |
| 432 | ACAACCCUU CAGAUUAC | 2268 | GUAAUCUG CUGAUGAGGNNNNNNNNCCGAA AGGGUUGU | 6424 |
| 433 | CAACCCUUC AGAUUACU | 2269 | AGUAAUCU CUGAUGAGGNNNNNNNNCCGAA AAGGGUUG | 6425 |
| 438 | CUUCAGAUU ACUUGCAG | 2270 | CUGCAAGU CUGAUGAGGNNNNNNNNCCGAA AUCUGAAG | 6426 |
| 439 | UUCAGAUUA CUUGCAGG | 2271 | CCUGCAAG CUGAUGAGGNNNNNNNNCCGAA AAUCUGAA | 6427 |
| 442 | AGAUUACUU GCAGGGGA | 2272 | UCCCCUGC CUGAUGAGGNNNNNNNNCCGAA AGUAAUCU | 6428 |
| 471 | GACUGGCUU UGGCCCAA | 1534 | UUGGGCCA CUGAUGAGGNNNNNNNNCCGAA AGCCAGUC | 5690 |
| 472 | ACUGGCUUU GGCCCAAU | 1535 | AUUGGGCC CUGAUGAGGNNNNNNNNCCGAA AAGCCAGU | 5691 |
| 484 | CCAAUGCUC AGCGUGAU | 2273 | AUCACGCU CUGAUGAGGNNNNNNNNCCGAA AGCAUUGG | 6429 |
| 493 | AGCGUGAUU CUGAGGAA | 2274 | UUCCUCAG CUGAUGAGGNNNNNNNNCCGAA AUCACGCU | 6430 |
| 494 | GCGUGAUUC UGAGGAAA | 2275 | UUUCCUCA CUGAUGAGGNNNNNNNNCCGAA AAUCACGC | 6431 |
| 507 | GAAAGGGUA UUGGUGAC | 2276 | GUCACCAA CUGAUGAGGNNNNNNNNCCGAA ACCCUUUC | 6432 |
| 509 | AAGGGUAUU GGUGACUG | 2277 | CAGUCACC CUGAUGAGGNNNNNNNNCCGAA AUACCCUU | 6433 |
| 538 | GUGACAGUA UCUUCUGC | 2278 | GCAGAAGA CUGAUGAGGNNNNNNNNCCGAA ACUGUCAC | 6434 |
| 540 | GACAGUAUC UUCUGCAA | 2279 | UUGCAGAA CUGAUGAGGNNNNNNNNCCGAA AUACUGUC | 6435 |
| 542 | CAGUAUCUU CUGCAAAA | 2280 | UUUUGCAG CUGAUGAGGNNNNNNNNCCGAA AGAUACUG | 6436 |
| 543 | AGUAUCUUC UGCAAAAC | 2281 | GUUUUGCA CUGAUGAGGNNNNNNNNCCGAA AAGAUACU | 6437 |
| 555 | AAAACACUC ACCAUUCC | 2282 | GGAAUGGU CUGAUGAGGNNNNNNNNCCGAA AGUGUUUU | 6438 |
| 561 | CUCACCAUU CCCAGGGU | 2283 | ACCCUGGG CUGAUGAGGNNNNNNNNCCGAA AUGGUGAG | 6439 |
| 562 | UCACCAUUC CAGGGUG | 2284 | CACCCUGG CUGAUGAGGNNNNNNNNCCGAA AAUGGUGA | 6440 |
| 573 | AGGGUGGUU GGAAAUGA | 2285 | UCAUUUCC CUGAUGAGGNNNNNNNNCCGAA ACCACCCU | 6441 |
| 583 | GAAAUGAUA CUGGAGCC | 2286 | GGCUCCAG CUGAUGAGGNNNNNNNNCCGAA AUCAUUUC | 6442 |
| 593 | UGGAGCCUA CAAGUGCU | 1546 | AGCACUUG CUGAUGAGGNNNNNNNNCCGAA AGGCUCCA | 5702 |
| 602 | CAAGUGCUC UACCGGG | 2287 | CCCGGUAC CUGAUGAGGNNNNNNNNCCGAA AGCACUUG | 6443 |
| 605 | GUGCUCGUA CCGGGACG | 2288 | CGUCCCGG CUGAUGAGGNNNNNNNNCCGAA ACGAGCAC | 6444 |
| 615 | CGGGACGUC GACAUAGC | 2289 | GCUAUGUC CUGAUGAGGNNNNNNNNCCGAA ACGUCCCG | 6445 |
| 621 | GUCGACAUA GCCUCCAC | 2290 | GUGGAGGC CUGAUGAGGNNNNNNNNCCGAA AUGUCGAC | 6446 |
| 626 | CAUAGCCUC CACUGUUU | 2291 | AAACAGUG CUGAUGAGGNNNNNNNNCCGAA AGGCUAUG | 6447 |
| 633 | UCCACUGUU UAUGUCUA | 2292 | UAGACAUA CUGAUGAGGNNNNNNNNCCGAA ACAGUGGA | 6448 |
| 634 | CCACUGUUU AUGUCUAU | 2293 | AUAGACAU CUGAUGAGGNNNNNNNNCCGAA AACAGUGG | 6449 |
| 635 | CACUGUUUA UGUCUAUG | 2294 | CAUAGACA CUGAUGAGGNNNNNNNNCCGAA AAACAGUG | 6450 |
| 639 | GUUUAUGUC UAUGUUCG | 2295 | CGAACAUA CUGAUGAGGNNNNNNNNCCGAA ACAUAAAC | 6451 |
| 641 | UUAUGUCUA UGUUCGAG | 2296 | CUCGAACA CUGAUGAGGNNNNNNNNCCGAA AGACAUAA | 6452 |
| 645 | GUCUAUGUU CGAGAUUA | 2297 | UAAUCUCG CUGAUGAGGNNNNNNNNCCGAA ACAUAGAC | 6453 |
| 646 | UCUAUGUUC GAGAUUAC | 2298 | GUAAUCUC CUGAUGAGGNNNNNNNNCCGAA AACAUAGA | 6454 |
| 652 | UUCGAGAUU ACAGAUCA | 2299 | UGAUCUGU CUGAUGAGGNNNNNNNNCCGAA AUCUCGAA | 6455 |
| 653 | UCGAGAUUA CAGAUCAC | 2300 | GUGAUCUG CUGAUGAGGNNNNNNNNCCGAA AAUCUCGA | 6456 |
| 659 | UUACAGAUC ACCAUUCA | 2301 | UGAAUGGU CUGAUGAGGNNNNNNNNCCGAA AUCUGUAA | 6457 |
| 665 | AUCACCAUU CAUCGCCU | 2302 | AGGCGAUG CUGAUGAGGNNNNNNNNCCGAA AUGGUGAU | 6458 |
| 666 | UCACCAUUC AUCGCCUC | 2303 | GAGGCGAU CUGAUGAGGNNNNNNNNCCGAA AAUGGUGA | 6459 |
| 669 | CCAUUCAUC GCCUCUGU | 2304 | ACAGAGGC CUGAUGAGGNNNNNNNNCCGAA AUGAAUGG | 6460 |
| 674 | CAUCGCCUC UGUCAGUG | 2305 | CACUGACA CUGAUGAGGNNNNNNNNCCGAA AGGCGAUG | 6461 |
| 678 | GCCUCUGUC AGUGACCA | 2306 | UGGUCACU CUGAUGAGGNNNNNNNNCCGAA ACAGAGGC | 6462 |
| 696 | CAUGGCAUC GUGUACAU | 2307 | AUGUACAC CUGAUGAGGNNNNNNNNCCGAA AUGCCAUG | 6463 |
| 701 | CAUCGUGUA CAUCACCG | 2308 | CGGUGAUG CUGAUGAGGNNNNNNNNCCGAA ACACGAUG | 6464 |
| 705 | GUGUACAUC ACCGAGAA | 2309 | UUCUCGGU CUGAUGAGGNNNNNNNNCCGAA AUGUACAC | 6465 |
| 735 | GUGGUGAUC CCCUGCCG | 2310 | CGGCAGGG CUGAUGAGGNNNNNNNNCCGAA AUCACCAC | 6466 |
| 749 | CCGAGGGUC GAUUUCAA | 2311 | UUGAAAUC CUGAUGAGGNNNNNNNNCCGAA ACCCUCGG | 6467 |
| 753 | GGGUCGAUU UCAAACCU | 2312 | AGGUUUGA CUGAUGAGGNNNNNNNNCCGAA AUCGACCC | 6468 |
| 754 | GGUCGAUUU CAAACCUC | 2313 | GAGGUUUG CUGAUGAGGNNNNNNNNCCGAA AAUCGACC | 6469 |
| 755 | GUCGAUUUC AAACCUCA | 2314 | UGAGGUUU CUGAUGAGGNNNNNNNNCCGAA AAAUCGAC | 6470 |
| 762 | UCAAACCUC AAUGUGUC | 2315 | GACACAUU CUGAUGAGGNNNNNNNNCCGAA AGGUUUGA | 6471 |
| 770 | CAAUGUGUC UCUUUGCG | 2316 | CGCAAAGA CUGAUGAGGNNNNNNNNCCGAA ACACAUUG | 6472 |
| 772 | AUGUGUCUC UUUGCGCU | 2317 | AGCGCAAA CUGAUGAGGNNNNNNNNCCGAA AGACACAU | 6473 |
| 774 | GUGUCUCUU UGCGCUAG | 2318 | CUAGCGCA CUGAUGAGGNNNNNNNNCCGAA AGAGACAC | 6474 |
| 775 | UGUCUCUUU GCGCUAGG | 2319 | CCUAGCGC CUGAUGAGGNNNNNNNNCCGAA AAGAGACA | 6475 |
| 781 | UUUGCGCUA GGUAUCCA | 2320 | UGGAUACC CUGAUGAGGNNNNNNNNCCGAA AGCGCAAA | 6476 |
| 785 | CGCUAGGUA UCCAGAAA | 2321 | UUUCUGGA CUGAUGAGGNNNNNNNNCCGAA ACCUAGCG | 6477 |
| 787 | CUAGGUAUC CAGAAAAG | 2322 | CUUUUCUG CUGAUGAGGNNNNNNNNCCGAA AUACCUAG | 6478 |
| 800 | AAAGAGAUU GUUCCGG | 2323 | CCGGAACA CUGAUGAGGNNNNNNNNCCGAA AUCUCUUU | 6479 |
| 801 | AAGAGAUUG UUCCGGA | 2324 | UCCGGAAC CUGAUGAGGNNNNNNNNCCGAA AAUCUCUU | 6480 |
| 804 | AGAUUGUU CCGGAUGG | 2325 | CCAUCCGG CUGAUGAGGNNNNNNNNCCGAA ACAAAUCU | 6481 |
| 805 | GAUUUGUUC CGGAUGGA | 2326 | UCCAUCCG CUGAUGAGGNNNNNNNNCCGAA AACAAAUC | 6482 |
| 822 | AACAGAAUU CCUGGGA | 1595 | UCCCAGGA CUGAUGAGGNNNNNNNNCCGAA AUUCUGUU | 5751 |
| 823 | ACAGAAUUC CUGGGAC | 1596 | GUCCCAGG CUGAUGAGGNNNNNNNNCCGAA AAUUCUGU | 5752 |
| 824 | CAGAAUUCC UGGGACA | 1597 | UGUCCCAG CUGAUGAGGNNNNNNNNCCGAA AAAUUCUG | 5753 |
| 840 | AGCGAGAUA GGCUUUAC | 2327 | GUAAAGCC CUGAUGAGGNNNNNNNNCCGAA AUCUCGCU | 6483 |
| 845 | GAUAGGCUU UACUCUCC | 2328 | GGAGAGUA CUGAUGAGGNNNNNNNNCCGAA AGCCUAUC | 6484 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 846 | AUAGGCUUU ACUCUCCC | 2329 | GGGAGAGU CUGAUGAGGNNNNNNNNCCGAA AAGCCUAU | 6485 |
| 847 | UAGGCUUUA CUCUCCCC | 2330 | GGGGAGAG CUGAUGAGGNNNNNNNNCCGAA AAAGCCUA | 6486 |
| 850 | GCUUUACUC UCCCCAGU | 2331 | ACUGGGGA CUGAUGAGGNNNNNNNNCCGAA AGUAAAGC | 6487 |
| 852 | UUUACUCUC CCCAGUUA | 2332 | UAACUGGG CUGAUGAGGNNNNNNNNCCGAA AGAGUAAA | 6488 |
| 859 | UCCCCAGUU ACAUGAUC | 2333 | GAUCAUGU CUGAUGAGGNNNNNNNNCCGAA ACUGGGGA | 6489 |
| 860 | CCCCAGUUA CAUGAUCA | 2334 | UGAUCAUG CUGAUGAGGNNNNNNNNCCGAA AACUGGGG | 6490 |
| 867 | UACAUGAUC AGCUAUGC | 1605 | GCAUAGCU CUGAUGAGGNNNNNNNNCCGAA AUCAUGUA | 5761 |
| 872 | GAUCAGCUA UGCCGGCA | 2335 | UGCCGGCA CUGAUGAGGNNNNNNNNCCGAA AGCUGAUC | 6491 |
| 885 | GGCAUGGUC UUCUGUGA | 1607 | UCACAGAA CUGAUGAGGNNNNNNNNCCGAA ACCAUGCC | 5763 |
| 887 | CAUGGUCUU CUGUGAGG | 2336 | CCUCACAG CUGAUGAGGNNNNNNNNCCGAA AGACCAUG | 6492 |
| 888 | AUGGUCUUC UGUGAGGC | 2337 | GCCUCACA CUGAUGAGGNNNNNNNNCCGAA AAGACCAU | 6493 |
| 903 | GCAAAGAUC AAUGAUGA | 2338 | UCAUCAUU CUGAUGAGGNNNNNNNNCCGAA AUCUUUGC | 6494 |
| 917 | UGAAACCUA UCAGUCUA | 2339 | UAGACUGA CUGAUGAGGNNNNNNNNCCGAA AGGUUUCA | 6495 |
| 919 | AAACCUAUC AGUCUAUC | 2340 | GAUAGACU CUGAUGAGGNNNNNNNNCCGAA AUAGGUUU | 6496 |
| 923 | CUAUCAGUC UAUCAUGU | 2341 | ACAUGAUA CUGAUGAGGNNNNNNNNCCGAA ACUGAUAG | 6497 |
| 925 | AUCAGUCUA UCAUGUAC | 2342 | GUACAUGA CUGAUGAGGNNNNNNNNCCGAA AGACUGAU | 6498 |
| 927 | CAGUCUAUC AUGUACAU | 2343 | AUGUACAU CUGAUGAGGNNNNNNNNCCGAA AUAGACUG | 5772 |
| 932 | UAUCAUGUA CAUAGUUG | 2344 | CAACUAUG CUGAUGAGGNNNNNNNNCCGAA ACAUGAUA | 6499 |
| 936 | AUGUACAUA GUUGUGGU | 2345 | ACCACAAC CUGAUGAGGNNNNNNNNCCGAA AUGUACAU | 6500 |
| 939 | UACAUAGUU GUGGUUGU | 2346 | ACAACCAC CUGAUGAGGNNNNNNNNCCGAA ACUAUGUA | 6501 |
| 945 | GUUGUGGUU GUAGGAUA | 2347 | UAUCCUAC CUGAUGAGGNNNNNNNNCCGAA ACCACAAC | 6502 |
| 948 | GUGGUUGUA GGAUAUAG | 2348 | CUAUAUCC CUGAUGAGGNNNNNNNNCCGAA ACAACCAC | 6503 |
| 953 | UGUAGGAUA UAGGAUUU | 2349 | AAAUCCUA CUGAUGAGGNNNNNNNNCCGAA AUCCUACA | 6504 |
| 955 | UAGGAUAUA GGAUUUAU | 2350 | AUAAAUCC CUGAUGAGGNNNNNNNNCCGAA AUAUCCUA | 6505 |
| 960 | UAUAGGAUU UAUGAUGU | 1626 | ACAUCAUA CUGAUGAGGNNNNNNNNCCGAA AUCCUAUA | 5782 |
| 961 | AUAGGAUUU AUGAUGUG | 1627 | CACAUCAU CUGAUGAGGNNNNNNNNCCGAA AAUCCUAU | 5783 |
| 962 | UAGGAUUUA UGAUGUGA | 2351 | UCACAUCA CUGAUGAGGNNNNNNNNCCGAA AAAUCCUA | 6506 |
| 972 | GAUGUGAUU CUGAGCCC | 2352 | GGGCUCAG CUGAUGAGGNNNNNNNNCCGAA AUCACAUC | 6507 |
| 973 | AUGUGAUUC UGAGCCCC | 2353 | GGGGCUCA CUGAUGAGGNNNNNNNNCCGAA AAUCACAU | 6508 |
| 993 | CAUGAAAUU GAGCUAUC | 2354 | GAUAGCUC CUGAUGAGGNNNNNNNNCCGAA AUUUCAUG | 6509 |
| 999 | AUUGAGCUA UCUGCCGG | 2355 | CCGGCAGA CUGAUGAGGNNNNNNNNCCGAA AGCUCAAU | 6510 |
| 1001 | UGAGCUAUC UGCCGGAG | 2356 | CUCCGGCA CUGAUGAGGNNNNNNNNCCGAA AUAGCUCA | 6511 |
| 1017 | GAAAAACUU GUCUUAAA | 2357 | UUUAAGAC CUGAUGAGGNNNNNNNNCCGAA AGUUUUUC | 6512 |
| 1020 | AAACUUGUC UUAAAUUG | 2358 | CAAUUUAA CUGAUGAGGNNNNNNNNCCGAA ACAAGUUU | 6513 |
| 1022 | ACUUGUCUU AAAUUGUA | 2359 | UACAAUUU CUGAUGAGGNNNNNNNNCCGAA AGACAAGU | 6514 |
| 1023 | CUUGUCUUA AAUUGUAC | 1641 | GUACAAUU CUGAUGAGGNNNNNNNNCCGAA AAGACAAG | 5797 |
| 1027 | UCUUAAAUU GUACAGCG | 2360 | CGCUGUAC CUGAUGAGGNNNNNNNNCCGAA AUUUAAGA | 6515 |
| 1030 | UAAAUUGUA CAGCGAGA | 2361 | UCUCGCUG CUGAUGAGGNNNNNNNNCCGAA ACAAUUUA | 6516 |
| 1047 | ACAGAGCUC AAGUGGGG | 2362 | CCCCACUU CUGAUGAGGNNNNNNNNCCGAA AGCUCUGU | 6517 |
| 1059 | GUGGGGCUU GAUUUCAC | 2363 | GUGAAAUC CUGAUGAGGNNNNNNNNCCGAA AGCCCCAC | 6518 |
| 1063 | GGCUUGAUU UCACCUGG | 2364 | CCAGGUGA CUGAUGAGGNNNNNNNNCCGAA AUCAAGCC | 6519 |
| 1064 | GCUUGAUUU CACCUGGC | 2365 | GCCAGGUG CUGAUGAGGNNNNNNNNCCGAA AAUCAAGC | 6520 |
| 1065 | CUUGAUUUC ACCUGGCA | 2366 | UGCCAGGU CUGAUGAGGNNNNNNNNCCGAA AAAUCAAG | 6521 |
| 1076 | CUGGCACUC UCCACCUU | 2367 | AAGGUGGA CUGAUGAGGNNNNNNNNCCGAA AGUGCCAG | 6522 |
| 1078 | GGCACUCUC CACCUUCA | 2368 | UGAAGGUG CUGAUGAGGNNNNNNNNCCGAA AGAGUGCC | 6523 |
| 1084 | CUCCACCUU CAAAGUCU | 2369 | AGACUUUG CUGAUGAGGNNNNNNNNCCGAA AGGUGGAG | 6524 |
| 1085 | UCCACCUUC AAAGUCUC | 2370 | GAGACUUU CUGAUGAGGNNNNNNNNCCGAA AAGGUGGA | 6525 |
| 1091 | UUCAAAGUC UCAUCAUA | 2371 | UAUGAUGA CUGAUGAGGNNNNNNNNCCGAA ACUUUGAA | 6526 |
| 1093 | CAAAGUCUC AUCAUAAG | 2372 | CUUAUGAU CUGAUGAGGNNNNNNNNCCGAA AGACUUUG | 6527 |
| 1096 | AGUCUCAUC AUAAGAAG | 2373 | CUUCUUAU CUGAUGAGGNNNNNNNNCCGAA AUGAGACU | 6528 |
| 1099 | CUCAUCAUA AGAAGAUU | 2374 | AAUCUUCU CUGAUGAGGNNNNNNNNCCGAA AUGAUGAG | 6529 |
| 1107 | AAGAAGAUU GUAAACCG | 2375 | CGGUUUAC CUGAUGAGGNNNNNNNNCCGAA AUCUUCUU | 6530 |
| 1110 | AAGAUUGUA AACGGGA | 2376 | UCCCGGUU CUGAUGAGGNNNNNNNNCCGAA ACAAUCUU | 6531 |
| 1130 | GAAACCCUU UCCUGGGA | 2377 | UCCCAGGA CUGAUGAGGNNNNNNNNCCGAA AGGGUUUC | 6532 |
| 1131 | AAACCCUUU CCUGGGAC | 2378 | GUCCCAGG CUGAUGAGGNNNNNNNNCCGAA AAGGGUUU | 6533 |
| 1132 | AACCCUUUC CUGGGACU | 2379 | AGUCCCAG CUGAUGAGGNNNNNNNNCCGAA AAAGGGUU | 6534 |
| 1154 | GAAGAUGUU UUUGAGCA | 2380 | UGCUCAAA CUGAUGAGGNNNNNNNNCCGAA ACAUCUUC | 6535 |
| 1155 | AAGAUGUUU UUGAGCAC | 2381 | GUGCUCAA CUGAUGAGGNNNNNNNNCCGAA AACAUCUU | 6536 |
| 1156 | AGAUGUUUU UGAGCACC | 2382 | GGUGCUCA CUGAUGAGGNNNNNNNNCCGAA AAACAUCU | 6537 |
| 1157 | GAUGUUUUU GAGCACCU | 2383 | AGGUGCUC CUGAUGAGGNNNNNNNNCCGAA AAAACAUC | 6538 |
| 1166 | GAGCACCUU GACAAUAG | 2384 | CUAUUGUC CUGAUGAGGNNNNNNNNCCGAA AGGUGCUC | 6539 |
| 1173 | UUGACAAUA GAAAGUGU | 2385 | ACACUUUC CUGAUGAGGNNNNNNNNCCGAA AUUGUCAA | 6540 |
| 1205 | AGGGGAAUA CACCGUG | 2386 | CACAGGUG CUGAUGAGGNNNNNNNNCCGAA AUUCCCCU | 6541 |
| 1215 | ACCUGUGUA GCGUCCAG | 2387 | CUGGACGC CUGAUGAGGNNNNNNNNCCGAA ACACAGGU | 6542 |
| 1220 | UGUAGCGUC CAGUGGAC | 2388 | GUCCACUG CUGAUGAGGNNNNNNNNCCGAA ACGCUACA | 6543 |
| 1236 | CGGAUGAUC AAGAGAAA | 2389 | UUUCUCUU CUGAUGAGGNNNNNNNNCCGAA AUCAUCCG | 6544 |
| 1246 | AGAGAAAUA GAACAUUU | 2390 | AAAUGUUC CUGAUGAGGNNNNNNNNCCGAA AUUUCUCU | 6545 |
| 1253 | UAGAACAUU UGUCCGAG | 2391 | CUCGGACA CUGAUGAGGNNNNNNNNCCGAA AUGUUCUA | 6546 |
| 1254 | AGAACAUUU GUCCGAGU | 2392 | ACUCGGAC CUGAUGAGGNNNNNNNNCCGAA AAUGUUCU | 6547 |
| 1257 | ACAUUUGUC CGAGUUCA | 2393 | UGAACUCG CUGAUGAGGNNNNNNNNCCGAA ACAAAUGU | 6548 |
| 1263 | GUCCGAGUU CACACAAA | 2394 | UUUGUGUG CUGAUGAGGNNNNNNNNCCGAA ACUCGGAC | 6549 |
| 1264 | UCCGAGUUC ACACAAAG | 2395 | CUUUGUGU CUGAUGAGGNNNNNNNNCCGAA AACUCGGA | 6550 |
| 1276 | CAAAGCCUU UAUUGCU | 2396 | AGCAAUAA CUGAUGAGGNNNNNNNNCCGAA AGGCUUUG | 6551 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1277 | AAAGCCUUU UAUUGCUU | 2397 | AAGCAAUA CUGAUGAGgnnnnnnnnCCGAA AAGGCUUU | 6552 |
| 1278 | AAGCCUUUU AUUGCUUU | 2398 | AAAGCAAU CUGAUGAGgnnnnnnnnCCGAA AAAGGCUU | 6553 |
| 1279 | AGCCUUUUA UUGCUUUC | 2399 | GAAAGCAA CUGAUGAGgnnnnnnnnCCGAA AAAAGGCU | 6554 |
| 1281 | CCUUUUAUU GCUUUCGG | 2400 | CCGAAAGC CUGAUGAGgnnnnnnnnCCGAA AUAAAAGG | 6555 |
| 1285 | UUAUUGCUU UCGGUAGU | 2401 | ACUACCGA CUGAUGAGgnnnnnnnnCCGAA AGCAAUAA | 6556 |
| 1286 | UAUUGCUUU CGGUAGUG | 2402 | CACUACCG CUGAUGAGgnnnnnnnnCCGAA AAGCAAUA | 6557 |
| 1287 | AUUGCUUUC GGUAGUGG | 2403 | CCACUACC CUGAUGAGgnnnnnnnnCCGAA AAAGCAAU | 6558 |
| 1291 | CUUUCGGUA GUGGGAUG | 2404 | CAUCCCAC CUGAUGAGgnnnnnnnnCCGAA ACCGAAAG | 6559 |
| 1304 | GAUGAAAUC UUUGGUGG | 2405 | CCACCAAA CUGAUGAGgnnnnnnnnCCGAA AUUUCAUC | 6560 |
| 1306 | UGAAAUCUU UGGUGGAA | 2406 | UUCCACCA CUGAUGAGgnnnnnnnnCCGAA AGAUUUCA | 6561 |
| 1307 | GAAAUCUUU GGUGGAAG | 2407 | CUUCCACC CUGAUGAGgnnnnnnnnCCGAA AAGAUUUC | 6562 |
| 1330 | UGGGCAGUC AAGUCCGA | 2408 | UCGGACUU CUGAUGAGgnnnnnnnnCCGAA ACUGCCCA | 6563 |
| 1335 | AGUCAAGUC CGAAUCCC | 2409 | GGGAUUCG CUGAUGAGgnnnnnnnnCCGAA ACUUGACU | 6564 |
| 1341 | GUCCGAAUC CCUGUGAA | 2410 | UUCACAGG CUGAUGAGgnnnnnnnnCCGAA AUUCGGAC | 6565 |
| 1352 | UGUGAAGUA UCUCAGUU | 2411 | AACUGAGA CUGAUGAGgnnnnnnnnCCGAA ACUUCACA | 6566 |
| 1354 | UGAAGUAUC UCAGUUAC | 2412 | GUAACUGA CUGAUGAGgnnnnnnnnCCGAA AUACUUCA | 6567 |
| 1356 | AAGUAUCUC AGUUACCC | 2413 | GGGUAACU CUGAUGAGgnnnnnnnnCCGAA AGAUACUU | 6568 |
| 1360 | AUCUCAGUU ACCCAGCU | 2414 | AGCUGGGU CUGAUGAGgnnnnnnnnCCGAA ACUGAGAU | 6569 |
| 1361 | UCUCAGUUA CCCAGCUC | 2415 | GAGCUGGG CUGAUGAGgnnnnnnnnCCGAA AACUGAGA | 6570 |
| 1369 | ACCCAGCUC CUGAUAUC | 2416 | GAUAUCAG CUGAUGAGgnnnnnnnnCCGAA AGCUGGGU | 6571 |
| 1375 | CUCCUGAUA UCAAAUGG | 2417 | CCAUUUGA CUGAUGAGgnnnnnnnnCCGAA AUCAGGAG | 6572 |
| 1377 | CCUGAUAUC AAAUGGUA | 2418 | UACCAUUU CUGAUGAGgnnnnnnnnCCGAA AUAUCAGG | 6573 |
| 1385 | CAAAUGGUA CAGAAAUG | 2419 | CAUUUCUG CUGAUGAGgnnnnnnnnCCGAA ACCAUUUG | 6574 |
| 1404 | AGGCCCAUU GAGUCCAA | 2420 | UUGGACUC CUGAUGAGgnnnnnnnnCCGAA AUGGGCCU | 6575 |
| 1409 | CAUUGAGUC CAACUACA | 2421 | UGUAGUUG CUGAUGAGgnnnnnnnnCCGAA ACUCAAUG | 6576 |
| 1415 | GUCCAACUA CACAAUGA | 2422 | UCAUUGUG CUGAUGAGgnnnnnnnnCCGAA AGUUGGAC | 6577 |
| 1425 | ACAAUGAUU GUUGGCGA | 2423 | UCGCCAAC CUGAUGAGgnnnnnnnnCCGAA AUCAUUGU | 6578 |
| 1428 | AUGAUUGUU GGCGAUGA | 2424 | UCAUCGCC CUGAUGAGgnnnnnnnnCCGAA ACAAUCAU | 6579 |
| 1440 | GAUGAACUC ACCAUCAU | 2425 | AUGAUGGU CUGAUGAGgnnnnnnnnCCGAA AGUUCAUC | 6580 |
| 1446 | CUCACCAUC AUGGAAGU | 2426 | ACUUCCAU CUGAUGAGgnnnnnnnnCCGAA AUGGUGAG | 6581 |
| 1478 | AGGAAACUA CACGGUCA | 2427 | UGACCGUG CUGAUGAGgnnnnnnnnCCGAA AGUUUCCU | 6582 |
| 1485 | UACACGGUC AUCCUCAC | 2428 | GUGAGGAU CUGAUGAGgnnnnnnnnCCGAA ACCGUGUA | 6583 |
| 1488 | ACGGUCAUC CUCACCAA | 2429 | UUGGUGAG CUGAUGAGgnnnnnnnnCCGAA AUGACCGU | 6584 |
| 1491 | GUCAUCCUC ACCAACCC | 2430 | GGGUUGGU CUGAUGAGgnnnnnnnnCCGAA AGGAUGAC | 6585 |
| 1503 | AACCCCAUU UCAAUGGA | 2431 | UCCAUUGA CUGAUGAGgnnnnnnnnCCGAA AUGGGGUU | 6586 |
| 1504 | ACCCCAUUU CAAUGGAG | 2432 | CUCCAUUG CUGAUGAGgnnnnnnnnCCGAA AAUGGGGU | 6587 |
| 1505 | CCCCAUUUC AAUGGAGA | 2433 | UCUCCAUU CUGAUGAGgnnnnnnnnCCGAA AAAUGGGG | 6588 |
| 1530 | CACAUGGUC UCUCUGGU | 2434 | ACCAGAGA CUGAUGAGgnnnnnnnnCCGAA ACCAUGUG | 6589 |
| 1532 | CAUGGUCUC UCUGGUUG | 2435 | CAACCAGA CUGAUGAGgnnnnnnnnCCGAA AGACCAUG | 6590 |
| 1534 | UGGUCUCUC UGGUUGUG | 1714 | CACAACCA CUGAUGAGgnnnnnnnnCCGAA AGAGACCA | 5870 |
| 1539 | UCUCUGGUU GUGAAUGU | 2436 | ACAUUCAC CUGAUGAGgnnnnnnnnCCGAA ACCAGAGA | 6591 |
| 1548 | GUGAAUGUC CACCCCA | 2437 | UGGGGUGG CUGAUGAGgnnnnnnnnCCGAA ACAUUCAC | 6592 |
| 1560 | CCCCAGAUC GGUGAGAA | 2438 | UUCUCACC CUGAUGAGgnnnnnnnnCCGAA AUCUGGGG | 5874 |
| 1574 | GAAAGCCUU GAUCUCGC | 2439 | GCGAGAUC CUGAUGAGgnnnnnnnnCCGAA AGGCUUUC | 6593 |
| 1578 | GCCUUGAUC UCGCCUAU | 2440 | AUAGGCGA CUGAUGAGgnnnnnnnnCCGAA AUCAAGGC | 6594 |
| 1580 | CUUGAUCUC GCCUAUGG | 2441 | CCAUAGGC CUGAUGAGgnnnnnnnnCCGAA AGAUCAAG | 6595 |
| 1585 | UCUCGCCUA UGGAUUCC | 2442 | GGAAUCCA CUGAUGAGgnnnnnnnnCCGAA AGGCGAGA | 6596 |
| 1591 | CUAUGGAUU CCUACCAG | 2443 | CUGGUAGG CUGAUGAGgnnnnnnnnCCGAA AUCCAUAG | 6597 |
| 1592 | UAUGGAUUC CUACCAGU | 2444 | ACUGGUAG CUGAUGAGgnnnnnnnnCCGAA AAUCCAUA | 6598 |
| 1595 | GGAUUCCUA CCAGUAUG | 2445 | CAUACUGG CUGAUGAGgnnnnnnnnCCGAA AGGAAUCC | 6599 |
| 1601 | CUACCAGUA UGGGACCA | 2446 | UGGUCCCA CUGAUGAGgnnnnnnnnCCGAA ACUGGUAG | 6600 |
| 1619 | GCAGACAUU GACAUGCA | 2447 | UGCAUGUC CUGAUGAGgnnnnnnnnCCGAA AUGUCUGC | 6601 |
| 1632 | UGCACAGUC UACGCCAA | 2448 | UUGGCGUA CUGAUGAGgnnnnnnnnCCGAA ACUGUGCA | 6602 |
| 1634 | CACAGUCUA CGCCAACC | 2449 | GGUUGGCG CUGAUGAGgnnnnnnnnCCGAA AGACUGUG | 6603 |
| 1645 | CCAACCCUC CCUGCAC | 2450 | GUGCAGGG CUGAUGAGgnnnnnnnnCCGAA AGGGUUGG | 6604 |
| 1659 | CACCACAUC CAGUGGUA | 2451 | UACCACUG CUGAUGAGgnnnnnnnnCCGAA AUGUGGUG | 6605 |
| 1667 | CCAGUGGUA CUGGCAGC | 2452 | GCUGCCAG CUGAUGAGgnnnnnnnnCCGAA ACCACUGG | 6606 |
| 1677 | UGGCAGCUA AAGAAGC | 2453 | GCUUCUUC CUGAUGAGgnnnnnnnnCCGAA AGCUGCCA | 6607 |
| 1691 | AGCCUGCUC CUACAGAC | 2454 | GUCUGUAG CUGAUGAGgnnnnnnnnCCGAA AGCAGGCU | 6608 |
| 1694 | CUGCUCCUA CAGACCCG | 2455 | CGGGUCUG CUGAUGAGgnnnnnnnnCCGAA AGGAGCAG | 6609 |
| 1718 | AAGCCCGUA UGCUUGUA | 2456 | UACAAGCA CUGAUGAGgnnnnnnnnCCGAA ACGGGCUU | 6610 |
| 1723 | CGUAUGCUU GUAAAGAA | 2457 | UUCUUUAC CUGAUGAGgnnnnnnnnCCGAA AGCAUACG | 6611 |
| 1726 | AUGCUUGUA AAGAAUGG | 2458 | CCAUUCUU CUGAUGAGgnnnnnnnnCCGAA ACAAGCAU | 6612 |
| 1750 | UGGAGGAUU UCCAGGGG | 2459 | CCCCUGGA CUGAUGAGgnnnnnnnnCCGAA AUCCUCCA | 6613 |
| 1751 | GGAGGAUUU CCAGGGGG | 2460 | CCCCCUGG CUGAUGAGgnnnnnnnnCCGAA AAUCCUCC | 6614 |
| 1752 | GAGGAUUUC CAGGGGGA | 2461 | CCCCCCUG CUGAUGAGgnnnnnnnnCCGAA AAAUCCUC | 6615 |
| 1770 | AACAAGAUC GAAGUCAC | 2462 | GUGACUUC CUGAUGAGgnnnnnnnnCCGAA AUCUUGUU | 6616 |
| 1776 | AUCGAAGUC ACCAAAAA | 2463 | UUUUUGGU CUGAUGAGgnnnnnnnnCCGAA ACUUCGAU | 6617 |
| 1790 | AAACCAAUA UGCCCUGA | 2464 | UCAGGGCA CUGAUGAGgnnnnnnnnCCGAA AUUGGUUU | 6618 |
| 1800 | GCCCUGAUU GAAGGAAA | 2465 | UUUCCUUC CUGAUGAGgnnnnnnnnCCGAA AUCAGGGC | 6619 |
| 1821 | AAAACUGUA AGUACGCU | 2466 | AGCGUACU CUGAUGAGgnnnnnnnnCCGAA ACAGUUUU | 6620 |
| 1825 | CUGUAAGUA CGCUGGUC | 2467 | GACCAGCG CUGAUGAGgnnnnnnnnCCGAA ACUUACAG | 6621 |
| 1833 | ACGCUGGUC AUCCAAGC | 2468 | GCUUGGAU CUGAUGAGgnnnnnnnnCCGAA ACCAGCGU | 6622 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 1836 | CUGGUCAUC CAAGCUGC | 2469 | GCAGCUUG CUGAUGAGGNNNNNNNNCCGAA AUGACCAG | 6623 |
| 1853 | CAACGUGUC AGCGUUGU | 2470 | ACAACGCU CUGAUGAGGNNNNNNNNCCGAA ACACGUUG | 6624 |
| 1859 | GUCAGCGUU GUACAAAU | 2471 | AUUUGUAC CUGAUGAGGNNNNNNNNCCGAA ACGCUGAC | 6625 |
| 1862 | AGCGUUGUA CAAAUGUG | 2472 | CACAUUUG CUGAUGAGGNNNNNNNNCCGAA ACAACGCU | 6626 |
| 1878 | GAAGCCAUC AACAAAGC | 2473 | GCUUUGUU CUGAUGAGGNNNNNNNNCCGAA AUGGCUUC | 6627 |
| 1905 | GAGAGGGUC AUCUCCUU | 2474 | AAGGAGAU CUGAUGAGGNNNNNNNNCCGAA ACCCUCUC | 6628 |
| 1908 | AGGGUCAUC UCCUUCCA | 2475 | UGGAAGGA CUGAUGAGGNNNNNNNNCCGAA AUGACCCU | 6629 |
| 1910 | GGUCAUCUC CUUCCAUG | 2476 | CAUGGAAG CUGAUGAGGNNNNNNNNCCGAA AGAUGACC | 6630 |
| 1913 | CAUCUCCUU CCAUGUGA | 2477 | UCACAUGG CUGAUGAGGNNNNNNNNCCGAA AGGAGAUG | 6631 |
| 1914 | AUCUCCUUC CAUGUGAU | 2478 | AUCACAUG CUGAUGAGGNNNNNNNNCCGAA AAGGAGAU | 6632 |
| 1923 | CAUGUGAUC AGGGGUCC | 2479 | GGACCCCU CUGAUGAGGNNNNNNNNCCGAA AUCACAUG | 6633 |
| 1930 | UCAGGGGUC CUGAAAUU | 2480 | AAUUUCAG CUGAUGAGGNNNNNNNNCCGAA ACCCCUGA | 6634 |
| 1938 | CCUGAAAUU ACUGUGCA | 2481 | UGCACAGU CUGAUGAGGNNNNNNNNCCGAA AUUUCAGG | 6635 |
| 1939 | CUGAAAUUA CUGUGCAA | 2482 | UUGCACAG CUGAUGAGGNNNNNNNNCCGAA AAUUUCAG | 6636 |
| 1982 | GAGUGUGUC CCUGUUGU | 2483 | ACAACAGG CUGAUGAGGNNNNNNNNCCGAA ACACACUC | 6637 |
| 1988 | GUCCCUGUU GUGCACUG | 2484 | CAGUGCAC CUGAUGAGGNNNNNNNNCCGAA ACAGGGAC | 6638 |
| 2008 | ACAGAAAUA CGUUUGAG | 2485 | CUCAAACG CUGAUGAGGNNNNNNNNCCGAA AUUUCUGU | 6639 |
| 2012 | AAAUACGUU UGAGAACC | 2486 | GGUUCUCA CUGAUGAGGNNNNNNNNCCGAA ACGUAUUU | 6640 |
| 2013 | AAUACGUUU GAGAACCU | 2487 | AGGUUCUC CUGAUGAGGNNNNNNNNCCGAA AACGUAUU | 6641 |
| 2022 | GAGAACCUC ACGUGGUA | 2488 | UACCACGU CUGAUGAGGNNNNNNNNCCGAA AGGUUCUC | 6642 |
| 2030 | CACGUGGUA CAAGCUUG | 2489 | CAAGCUUG CUGAUGAGGNNNNNNNNCCGAA ACCACGUG | 6643 |
| 2037 | UACAAGCUU GGCUCACA | 2490 | UGUGAGCC CUGAUGAGGNNNNNNNNCCGAA AGCUUGUA | 6644 |
| 2042 | GCUUGGCUC ACAGGCAA | 2491 | UUGCCUGU CUGAUGAGGNNNNNNNNCCGAA AGCCAAGC | 6645 |
| 2054 | GGCAACAUC GGUCCACA | 2492 | UGUGGACC CUGAUGAGGNNNNNNNNCCGAA AUGUUGCC | 6646 |
| 2058 | ACAUCGGUC CACAUGGG | 2493 | CCCAUGUG CUGAUGAGGNNNNNNNNCCGAA ACCGAUGU | 6647 |
| 2072 | GGGCGAAUC ACUCACAC | 2494 | GUGUGAGU CUGAUGAGGNNNNNNNNCCGAA AUUCGCCC | 6648 |
| 2076 | GAAUCACUC ACACCAGU | 2495 | ACUGGUGU CUGAUGAGGNNNNNNNNCCGAA AGUGAUUC | 6649 |
| 2085 | ACACCAGUU GCAAGAA | 2496 | UUCUUGCA CUGAUGAGGNNNNNNNNCCGAA ACUGGUGU | 6650 |
| 2086 | CACCAGUUU GCAAGAAC | 2497 | GUUCUUGC CUGAUGAGGNNNNNNNNCCGAA AACUGGUG | 6651 |
| 2096 | CAAGAACUU GGAUGCUC | 2498 | GAGCAUCC CUGAUGAGGNNNNNNNNCCGAA AGUUCUUG | 6652 |
| 2104 | UGGAUGCUC UUUGGAAA | 2499 | UUUCCAAA CUGAUGAGGNNNNNNNNCCGAA AGCAUCCA | 6653 |
| 2106 | GAUGCUCUU UGGAAACU | 2500 | AGUUUCCA CUGAUGAGGNNNNNNNNCCGAA AGAGCAUC | 6654 |
| 2107 | AUGCUCUUU GGAAACUG | 2401 | CAGUUUCC CUGAUGAGGNNNNNNNNCCGAA AAGAGCAU | 6655 |
| 2129 | CACCAUGUU UUCUAACA | 2502 | UGUUAGAA CUGAUGAGGNNNNNNNNCCGAA ACAUGGUG | 6656 |
| 2130 | ACCAUGUUU UCUAACAG | 2503 | CUGUUAGA CUGAUGAGGNNNNNNNNCCGAA AACAUGGU | 6657 |
| 2131 | CCAUGUUUU CUAACAGC | 2504 | GCUGUUAG CUGAUGAGGNNNNNNNNCCGAA AAACAUGG | 6658 |
| 2132 | CAUGUUUUC UAACAGCA | 2505 | UGCUGUUA CUGAUGAGGNNNNNNNNCCGAA AAAACAUG | 6659 |
| 2134 | UGUUUUCUA ACAGCACA | 2506 | UGUGCUGU CUGAUGAGGNNNNNNNNCCGAA AGAAAACA | 6660 |
| 2151 | AAUGACAUC UUGAUUGU | 2507 | ACAAUCAA CUGAUGAGGNNNNNNNNCCGAA AUGUCAUU | 6661 |
| 2153 | UGACAUCUU GAUUGUGG | 2508 | CCACAAUC CUGAUGAGGNNNNNNNNCCGAA AGAUGUCA | 6662 |
| 2157 | AUCUUGAUU GUGGCAUU | 2509 | AAUGCCAC CUGAUGAGGNNNNNNNNCCGAA AUCAAGAU | 6663 |
| 2165 | UGUGGCAUU UCAGAAUG | 2510 | CAUUCUGA CUGAUGAGGNNNNNNNNCCGAA AUGCCACA | 6664 |
| 2166 | GUGGCAUUU CAGAAUGC | 2511 | GCAUUCUG CUGAUGAGGNNNNNNNNCCGAA AAUGCCAC | 6665 |
| 2167 | UGGCAUUUC AGAAUGCC | 2512 | GGCAUUCU CUGAUGAGGNNNNNNNNCCGAA AAAUGCCA | 6666 |
| 2177 | GAAUGCCUC UCUGCAGG | 2513 | CCUGCAGA CUGAUGAGGNNNNNNNNCCGAA AGGCAUUC | 6667 |
| 2179 | AUGCUCUC UGCAGGAC | 2514 | GUCCUGCA CUGAUGAGGNNNNNNNNCCGAA AGAGGCAU | 6668 |
| 2198 | AGGCGACUA UGUUUGCU | 2515 | AGCAAACA CUGAUGAGGNNNNNNNNCCGAA AGUCGCCU | 6669 |
| 2202 | GACUAUGUU UGCUCUGC | 2516 | GCAGAGCA CUGAUGAGGNNNNNNNNCCGAA ACAUAGUC | 6670 |
| 2203 | ACUAUGUUU GCUCUGCU | 2517 | AGCAGAGC CUGAUGAGGNNNNNNNNCCGAA AACAUAGU | 6671 |
| 2207 | UGUUUGCUC UGCUCAAG | 2518 | CUUGAGCA CUGAUGAGGNNNNNNNNCCGAA AGCAAACA | 6672 |
| 2212 | GCUCUGCUC AAGAUAAG | 2519 | CUUAUCUU CUGAUGAGGNNNNNNNNCCGAA AGCAGAGC | 6673 |
| 2218 | CUCAAGAUA AGAAGCU | 2520 | GGUCUUCU CUGAUGAGGNNNNNNNNCCGAA AUCUGGAG | 6674 |
| 2239 | AAAGACAUU GCCUGGUC | 2521 | GACCAGGC CUGAUGAGGNNNNNNNNCCGAA AUGUCUUU | 6675 |
| 2247 | UGCCUGGUC AAACAGCU | 2522 | AGCUGUUU CUGAUGAGGNNNNNNNNCCGAA ACCAGGCA | 6676 |
| 2256 | AAACAGCUC AUCAUCCU | 2523 | AGGAUGAU CUGAUGAGGNNNNNNNNCCGAA AGCUGUUU | 6677 |
| 2259 | CAGCUCAUC AUCCUAGA | 2524 | UCUAGGAU CUGAUGAGGNNNNNNNNCCGAA AUGAGCUG | 6678 |
| 2262 | CUCAUCAUC CUAGAGCG | 2525 | CGCUCUAG CUGAUGAGGNNNNNNNNCCGAA AUGAUGAG | 6679 |
| 2265 | AUCAUCCUA GAGCGCAU | 2526 | AUGCGCUC CUGAUGAGGNNNNNNNNCCGAA AGGAUGAU | 6680 |
| 2286 | CCCAUGAUC ACCGGAAA | 2527 | UUUCCGGU CUGAUGAGGNNNNNNNNCCGAA AUCAUGGG | 6681 |
| 2296 | CCGGAAAUC UGGAGAAU | 2528 | AUUCUCCA CUGAUGAGGNNNNNNNNCCGAA AUUUCCGG | 6682 |
| 2305 | UGGAGAAUC AGACAACA | 2529 | UGUUGUCU CUGAUGAGGNNNNNNNNCCGAA AUUCUCCA | 6683 |
| 2319 | ACAACCAUU GGCGAGAC | 2530 | GUCUCGCC CUGAUGAGGNNNNNNNNCCGAA AUGGUUGU | 6684 |
| 2331 | GAGACCAUU GAAGUGAC | 2531 | GUCACUUC CUGAUGAGGNNNNNNNNCCGAA AUGGUCUC | 6685 |
| 2341 | AAGUGACUU GCCCAGCA | 2532 | UGCUGGGC CUGAUGAGGNNNNNNNNCCGAA AGUCACUU | 6686 |
| 2351 | CCCAGCAUC UGGAAAUC | 2533 | GAUUUCCA CUGAUGAGGNNNNNNNNCCGAA AUGCUGGG | 6687 |
| 2359 | CUGGAAAUC CUACCCCA | 2534 | UGGGGUAG CUGAUGAGGNNNNNNNNCCGAA AUUUCCAG | 6688 |
| 2362 | GAAAUCCUA CCCCACAC | 2535 | GUGUGGGG CUGAUGAGGNNNNNNNNCCGAA AGGAUUUC | 6689 |
| 2373 | CCACACAUU ACAUGGUU | 2536 | AACCAUGU CUGAUGAGGNNNNNNNNCCGAA AUGUGUGG | 6690 |
| 2374 | CACACAUUA CAUGGUUC | 2537 | GAACCAUG CUGAUGAGGNNNNNNNNCCGAA AAUGUGUG | 6691 |
| 2381 | UACAUGGUU CAAAGACA | 2538 | UGUCUUUG CUGAUGAGGNNNNNNNNCCGAA ACCAUGUA | 6692 |
| 2382 | ACAUGGUUC AAAGACAA | 2539 | UUGUCUUU CUGAUGAGGNNNNNNNNCCGAA AACCAUGU | 6693 |
| 2403 | ACCCUGGUA GAAGAUUC | 2540 | GAAUCUUC CUGAUGAGGNNNNNNNNCCGAA ACCAGGGU | 6694 |
| 2410 | UAGAAGAUU CAGGCAUU | 2541 | AAUGCCUG CUGAUGAGGNNNNNNNNCCGAA AUCUUCUA | 6695 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2411 | AGAAGAUUC AGGCAUUG | 2542 | CAAUGCCU CUGAUGAGGNNNNNNNNCCGAA AAUCUUCU | 6696 |
| 2418 | UCAGGCAUU GUACUGAG | 2543 | CUCAGUAC CUGAUGAGGNNNNNNNNCCGAA AUGCCUGA | 6697 |
| 2421 | GGCAUUGUA CUGAGAGA | 2544 | UCUCUCAG CUGAUGAGGNNNNNNNNCCGAA ACAAUGCC | 6698 |
| 2449 | ACCUGACUA UCCGCAGG | 2545 | CCUGCGGA CUGAUGAGGNNNNNNNNCCGAA AGUCAGGU | 6699 |
| 2451 | CUGACUAUC CGCAGGGU | 2546 | ACCCUGCG CUGAUGAGGNNNNNNNNCCGAA AUAGUCAG | 6700 |
| 2481 | GGAGGCCUC UACACCUG | 2547 | CAGGUGUA CUGAUGAGGNNNNNNNNCCGAA AGGCCUCC | 6701 |
| 2483 | AGGCCUCUA CACCUGCC | 1847 | GGCAGGUG CUGAUGAGGNNNNNNNNCCGAA AGAGGCCU | 6003 |
| 2505 | UGCAAUGUC CUUGGCUG | 2548 | CAGCCAAG CUGAUGAGGNNNNNNNNCCGAA ACAUUGCA | 6702 |
| 2508 | AAUGUCCUU GGCUGUGC | 2549 | GCACAGCC CUGAUGAGGNNNNNNNNCCGAA AGGACAUU | 6703 |
| 2532 | GAGACGCUC UUCAUAAU | 2550 | AUUAUGAA CUGAUGAGGNNNNNNNNCCGAA AGCGCUCU | 6704 |
| 2534 | GACGCUCUU CAUAAUAG | 2551 | CUAUUAUG CUGAUGAGGNNNNNNNNCCGAA AGAGCGUC | 6705 |
| 2535 | ACGCUCUUC AUAAUAGA | 2552 | UCUAUUAU CUGAUGAGGNNNNNNNNCCGAA AAGAGCGU | 6706 |
| 2538 | CUCUUCAUA AUAGAAGG | 2553 | CCUUCUAU CUGAUGAGGNNNNNNNNCCGAA AUGAAGAG | 6707 |
| 2541 | UUCAUAAUA GAAGGUGC | 1857 | GCACCUUC CUGAUGAGGNNNNNNNNCCGAA AUUAUGAA | 6013 |
| 2567 | GACCAACUU GGAAGUCA | 2554 | UGACUUCC CUGAUGAGGNNNNNNNNCCGAA AGUUGGUC | 6708 |
| 2574 | UUGGAAGUC AUUAUCCU | 2555 | AGGAUAAU CUGAUGAGGNNNNNNNNCCGAA ACUUCCAA | 6709 |
| 2577 | GAAGUCAUU AUCCUCGU | 2556 | ACGAGGAU CUGAUGAGGNNNNNNNNCCGAA AUGACUUC | 6710 |
| 2578 | AAGUCAUUA UCCUCGUC | 2557 | GACGAGGA CUGAUGAGGNNNNNNNNCCGAA AAUGACUU | 6711 |
| 2580 | GUCAUUAUC CUCGUCGG | 2558 | CCGACGAG CUGAUGAGGNNNNNNNNCCGAA AUAAUGAC | 6712 |
| 2583 | AUUAUCCUC GUCGGCAC | 2559 | GUGCCGAC CUGAUGAGGNNNNNNNNCCGAA AGGAUAAU | 6713 |
| 2586 | AUCCUCGUC GGCACUGC | 2560 | GCAGUGCC CUGAUGAGGNNNNNNNNCCGAA ACGAGGAU | 6714 |
| 2601 | GCAGUGAUU GCCAUGUU | 2561 | AACAUGGC CUGAUGAGGNNNNNNNNCCGAA AUCACUGC | 6715 |
| 2609 | UGCCAUGUU CUUCUGGC | 1867 | GCCAGAAG CUGAUGAGGNNNNNNNNCCGAA ACAUGGCA | 6023 |
| 2610 | GCCAUGUUC UUCUGGCU | 1868 | AGCCAGAA CUGAUGAGGNNNNNNNNCCGAA AACAUGGC | 6024 |
| 2612 | CAUGUUCUU CUGGCUCC | 2562 | GGAGCCAG CUGAUGAGGNNNNNNNNCCGAA AGAACAUG | 6716 |
| 2613 | AUGUUCUUC UGGCUCCU | 2563 | AGGAGCCA CUGAUGAGGNNNNNNNNCCGAA AAGAACAU | 6717 |
| 2619 | UUCUGGCUC CUUCUUGU | 2564 | ACAAGAAG CUGAUGAGGNNNNNNNNCCGAA AGCCAGAA | 6027 |
| 2622 | UGGCUCCUU CUUGUCAU | 2565 | AUGACAAG CUGAUGAGGNNNNNNNNCCGAA AGGAGCCA | 6718 |
| 2623 | GGCUCCUUC UUGUCAUU | 2566 | AAUGACAA CUGAUGAGGNNNNNNNNCCGAA AAGGAGCC | 6719 |
| 2625 | CUCCUUCUU GUCAUUGU | 2567 | ACAAUGAC CUGAUGAGGNNNNNNNNCCGAA AGAAGGAG | 6720 |
| 2628 | CUUCUUGUC AUUGUCCU | 2568 | AGGACAAU CUGAUGAGGNNNNNNNNCCGAA ACAAGAAG | 6721 |
| 2631 | CUUGUCAUU GUCCUACG | 2569 | CGUAGGAC CUGAUGAGGNNNNNNNNCCGAA AUGACAAG | 6722 |
| 2634 | GUCAUUGUC CUACGGAC | 2570 | GUCCGUAG CUGAUGAGGNNNNNNNNCCGAA ACAAUGAC | 6723 |
| 2637 | AUUGUCCUA CGGACCGU | 2571 | ACGGUCCG CUGAUGAGGNNNNNNNNCCGAA AGGACAAU | 6724 |
| 2646 | CGGACCGUU AAGCGGGC | 2572 | GCCCGCUU CUGAUGAGGNNNNNNNNCCGAA ACGGUCCG | 6725 |
| 2647 | GGACCGUUA AGCGGGCC | 1880 | GGCCCGCU CUGAUGAGGNNNNNNNNCCGAA AACGGUCC | 6036 |
| 2681 | GACAGGCUA CUUGUCUA | 2573 | UAGACAAG CUGAUGAGGNNNNNNNNCCGAA AGCCUGUC | 6726 |
| 2684 | AGGCUACUU GUCUAUUG | 2574 | CAAUAGAC CUGAUGAGGNNNNNNNNCCGAA AGUAGCCU | 6727 |
| 2687 | CUACUUGUC UAUUGUCA | 2575 | UGACAAUA CUGAUGAGGNNNNNNNNCCGAA ACAAGUAG | 6728 |
| 2689 | ACUUGUCUA UUGUCAUG | 2576 | CAUGACAA CUGAUGAGGNNNNNNNNCCGAA AGACAAGU | 6729 |
| 2691 | UUGUCUAUU GUCAUGGA | 2577 | UCCAUGAC CUGAUGAGGNNNNNNNNCCAA AUAGACAA | 6730 |
| 2694 | UCUAUUGUC AUGGAUCC | 2578 | GGAUCCAU CUGAUGAGGNNNNNNNNCCGAA ACAAUAGA | 6731 |
| 2701 | UCAUGGAUC CAGAUGAA | 1886 | UUCAUCUG CUGAUGAGGNNNNNNNNCCGAA AUCCAUGA | 6042 |
| 2711 | AGAUGAAUU GCCCUUGG | 2579 | CCAAGGGC CUGAUGAGGNNNNNNNNCCGAA AUUCAUCU | 6732 |
| 2717 | AUUGCCCUU GGAUGAGC | 2580 | GCUCAUCC CUGAUGAGGNNNNNNNNCCGAA AGGGCAAU | 6733 |
| 2738 | UGAACGCUU GCCUUAUG | 2581 | CAUAAGGC CUGAUGAGGNNNNNNNNCCGAA AGCGUUCA | 6734 |
| 2743 | GCUUGCCUU AUGAUGCC | 2582 | GGCAUCAU CUGAUGAGGNNNNNNNNCCGAA AGGCAAGC | 6735 |
| 2744 | CUUGCCUUA UGAUGCCA | 2583 | UGGCAUCA CUGAUGAGGNNNNNNNNCCGAA AAGGCAAG | 6736 |
| 2765 | GUGGGAAUU CCCCAGGG | 2584 | CCCUGGGG CUGAUGAGGNNNNNNNNCCGAA AUUCCCAC | 6737 |
| 2766 | UGGGAAUUC CCCAGGGA | 2585 | UCCCUGGG CUGAUGAGGNNNNNNNNCCGAA AAUUCCCA | 6738 |
| 2787 | CUGAAACUA GGAAAACC | 2586 | GGUUUUCC CUGAUGAGGNNNNNNNNCCGAA AGUUUCAG | 6739 |
| 2797 | GAAAACCUC UUGGCCGC | 2587 | GCGGCCAA CUGAUGAGGNNNNNNNNCCGAA AGGUUUUC | 6740 |
| 2799 | AAACCUCUU GGCCGCGG | 2588 | CCGCGGCC CUGAUGAGGNNNNNNNNCCGAA AGAGGUUU | 6741 |
| 2813 | CGGUGCCUU CGGCCAAG | 2589 | CUUGGCCG CUGAUGAGGNNNNNNNNCCGAA AGGCACCG | 6742 |
| 2814 | GGUGCCUUC GGCCAAGU | 2590 | ACUUGGCC CUGAUGAGGNNNNNNNNCCGAA AAGGCACC | 6743 |
| 2826 | CAAGUGAUU GAGGCAGA | 2591 | UCUGCCUC CUGAUGAGGNNNNNNNNCCGAA AUCACUUG | 6744 |
| 2839 | CAGACGCUU UUGGAAUU | 2592 | AAUUCCAA CUGAUGAGGNNNNNNNNCCGAA AGCGUCUG | 6745 |
| 2840 | AGACGCUUU UGGAAUUG | 2593 | CAAUUCCA CUGAUGAGGNNNNNNNNCCGAA AAGCGUCU | 6746 |
| 2841 | GACGCUUUU GGAAUUGA | 2594 | UCAAUUCC CUGAUGAGGNNNNNNNNCCGAA AAAGCGUC | 6747 |
| 2847 | UUUGGAAUU GACAAGAC | 1903 | GUCUUGUC CUGAUGAGGNNNNNNNNCCGAA AUUCCAAA | 6059 |
| 2863 | CAGCGACUU GCAAAACA | 2595 | UGUUUUGC CUGAUGAGGNNNNNNNNCCGAA AGUCGCUG | 6748 |
| 2874 | AAAACAGUA GCCGUCAA | 2596 | UUGACGGC CUGAUGAGGNNNNNNNNCCGAA ACUGUUUU | 6749 |
| 2880 | GUAGCCGUC AAGAUGUU | 2597 | AACAUCUU CUGAUGAGGNNNNNNNNCCGAA ACGGCUAC | 6750 |
| 2888 | CAAGAUGUU GAAAGAAG | 2598 | CUUCUUUC CUGAUGAGGNNNNNNNNCCGAA ACAUCUUG | 6751 |
| 2917 | GCGAGCAUC GAGCCCUC | 2599 | GAGGGCUC CUGAUGAGGNNNNNNNNCCGAA AUGCUCGC | 6752 |
| 2925 | CGAGCCCUC AUGUCUGA | 2600 | UCAGACAU CUGAUGAGGNNNNNNNNCCGAA AGGGCUCG | 6753 |
| 2930 | CCUCAUGUC UGAACUCA | 2601 | UGAGUUCA CUGAUGAGGNNNNNNNNCCGAA ACAUGAGG | 6754 |
| 2937 | UCUGAACUC AAGAUCCU | 1912 | AGGAUCUU CUGAUGAGGNNNNNNNNCCGAA AGUUCAGA | 6068 |
| 2943 | CUCAAGAUC CUCAUCCA | 2602 | UGGAUGAG CUGAUGAGGNNNNNNNNCCGAA AUCUUGAG | 6755 |
| 2946 | AAGAUCCUC AUCCACAU | 2603 | AUGUGGAU CUGAUGAGGNNNNNNNNCCGAA AGGAUCUU | 6756 |
| 2949 | AUCCUCAUC CACAUUGG | 2604 | CCAAUGUG CUGAUGAGGNNNNNNNNCCGAA AUGAGGAU | 6757 |
| 2955 | AUCCACAUU GGUCACCA | 2605 | UGGUGACC CUGAUGAGGNNNNNNNNCCGAA AUGUGGAU | 6758 |
| 2959 | ACAUUGGUC ACCAUCUC | 2606 | GAGAUGGU CUGAUGAGGNNNNNNNNCCGAA ACCAAUGU | 6759 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 2965 | GUCACCAUC UCAAUGUG | 1920 | CACAUUGA CUGAUGAGGNNNNNNNNCCGAA AUGGUGAC | 6076 |
| 2967 | CACCAUCUC AAUGUGGU | 1921 | ACCACAUU CUGAUGAGGNNNNNNNNCCGAA AGAUGGUG | 6077 |
| 2982 | GUGAACCUC CUAGGCGC | 2607 | GCGCCUAG CUGAUGAGGNNNNNNNNCCGAA AGGUUCAC | 6760 |
| 2985 | AACCUCCUA GGCGCCUG | 2608 | CAGGCGCC CUGAUGAGGNNNNNNNNCCGAA AGGAGGUU | 6761 |
| 3013 | GAGGGCCUC UCAUGGUG | 2609 | CACCAUGA CUGAUGAGGNNNNNNNNCCGAA AGGCCCUC | 6762 |
| 3015 | GGGCCUCUC AUGGUGAU | 2610 | AUCACCAU CUGAUGAGGNNNNNNNNCCGAA AGAGGCCC | 6763 |
| 3024 | AUGGUGAUU GUGGAAUU | 1928 | AAUUCCAC CUGAUGAGGNNNNNNNNCCGAA AUCACCAU | 6084 |
| 3032 | UGUGCAAUU CUGCAAGU | 2611 | ACUUGCAG CUGAUGAGGNNNNNNNNCCGAA AUUCCACA | 6764 |
| 3033 | GUGGAAUUC UGCAAGUU | 2612 | AACUUGCA CUGAUGAGGNNNNNNNNCCGAA AAUUCCAC | 6765 |
| 3041 | CUGCAACUU UGGAAACC | 2613 | GGUUUCCA CUGAUGAGGNNNNNNNNCCGAA ACUUGCAG | 6766 |
| 3042 | UGCAAGUUU GGAAACCU | 2614 | AGGUUUCC CUGAUGAGGNNNNNNNNCCGAA AACUUGCA | 6767 |
| 3051 | GGAAACCUA UCAACUUA | 2615 | UAAGUUGA CUGAUGAGGNNNNNNNNCCGAA AGGUUUCC | 6768 |
| 3053 | AAACCUAUC AACUUACU | 2616 | AGUAAGUU CUGAUGAGGNNNNNNNNCCGAA AUAGGUUU | 6769 |
| 3058 | UAUCAACUU ACUUACGG | 2617 | CCGUAAGU CUGAUGAGGNNNNNNNNCCGAA AGUUGAUA | 6770 |
| 3059 | AUCAACUUA CUUACGGG | 2618 | CCCGUAAG CUGAUGAGGNNNNNNNNCCGAA AAGUUGAU | 6771 |
| 3062 | AACUUACUU ACGGGCA | 2619 | UGCCCCGU CUGAUGAGGNNNNNNNNCCGAA AGUAACUU | 6772 |
| 3063 | ACUUACUUA CGGGGCAA | 2620 | UUGCCCCG CUGAUGAGGNNNNNNNNCCGAA AAGUAAGU | 6773 |
| 3083 | AAAUGAAUU UGUUCCCU | 2621 | AGGGAACA CUGAUGAGGNNNNNNNNCCGAA AUUCAUUU | 6774 |
| 3084 | AAUGAAUUU GUUCCCUA | 2622 | UAGGGAAC CUGAUGAGGNNNNNNNNCCGAA AAUUCAUU | 6775 |
| 3087 | GAAUUUGUU CCCUAUAA | 2623 | UUAUAGGG CUGAUGAGGNNNNNNNNCCGAA ACAAAUUC | 6776 |
| 3088 | AAUUUGUUC CCUAUAAG | 2624 | CUUAUAGG CUGAUGAGGNNNNNNNNCCGAA AACAAAUU | 6777 |
| 3092 | UGUUCCCUA UAAGAGCA | 2625 | UGCUCUUA CUGAUGAGGNNNNNNNNCCGAA AGGGAACA | 6778 |
| 3094 | UUCCCUAUA AGAGCAAA | 2626 | UUUGCUCU CUGAUGAGGNNNNNNNNCCGAA AUAGGGAA | 6779 |
| 3113 | GGCACGCUU CCGCCAGG | 2627 | CCUGGCGG CUGAUGAGGNNNNNNNNCCGAA AGCGUGCC | 6780 |
| 3114 | GCACGCUUC CGCCAGGG | 2628 | CCCUGGCG CUGAUGAGGNNNNNNNNCCGAA AAGCGUGC | 6781 |
| 3131 | CAAGGACUA CGUUGGGG | 2629 | CCCCAACG CUGAUGAGGNNNNNNNNCCGAA AGUCCUUG | 6782 |
| 3135 | GACUACGUU GGGGAGCU | 2630 | AGCUCCCC CUGAUGAGGNNNNNNNNCCGAA ACGUAGUC | 6783 |
| 3144 | GGGGAGCUC UCCGUGGA | 2631 | UCCACGGA CUGAUGAGGNNNNNNNNCCGAA AGCUCCCC | 6784 |
| 3146 | GGAGCUCUC CGUGGAUC | 2632 | GAUCCACG CUGAUGAGGNNNNNNNNCCGAA AGAGCUCC | 6785 |
| 3154 | CCGUGGAUC UGAAAAGA | 2633 | UCUUUUCA CUGAUGAGGNNNNNNNNCCGAA AUCCACGG | 6786 |
| 3167 | AAGACGCUU GGACAGCA | 2634 | UGCUGUCC CUGAUGAGGNNNNNNNNCCGAA AGCGUCUU | 6787 |
| 3177 | GACAGCAUC ACCAGCAG | 2635 | CUGCUGGU CUGAUGAGGNNNNNNNNCCGAA AUGCUGUC | 6788 |
| 3194 | CCAGAGCUC UGCCAGCU | 2636 | AGCUGGCA CUGAUGAGGNNNNNNNNCCGAA AGCUCUGG | 6789 |
| 3203 | UGCCAGCUC AGGCUUUG | 2637 | CAAAGCCU CUGAUGAGGNNNNNNNNCCGAA AGCUGGCA | 6790 |
| 3209 | CUCAGGCUU UCUUGAGG | 2638 | CCUCAACA CUGAUGAGGNNNNNNNNCCGAA AGCCUGAA | 6791 |
| 3210 | UCAGGCUUU GUUGAGGA | 2639 | UCCUCAAC CUGAUGAGGNNNNNNNNCCGAA AAGCCUGA | 6792 |
| 3213 | GGCUUUGUU GAGGAGAA | 2640 | UUCUCCUC CUGAUGAGGNNNNNNNNCCGAA ACAAAGCC | 6793 |
| 3224 | GGAGAAAUC GCUCAGUG | 2641 | CACUGAGC CUGAUGAGGNNNNNNNNCCGAA AUUUCUCC | 6794 |
| 3228 | AAAUCGCUC AGUGAUGU | 2642 | ACAUCACU CUGAUGAGGNNNNNNNNCCGAA AGCGAUUU | 6795 |
| 3237 | AGUGAUGUA GAGGAAGA | 2643 | UCUUCCUC CUGAUGAGGNNNNNNNNCCGAA ACAUCACU | 4658 |
| 3253 | AAGAAGCUU CUGAAGAA | 2644 | UUCUUCAG CUGAUGAGGNNNNNNNNCCGAA AGCUUCUU | 6796 |
| 3254 | AGAAGCUUC UGAAGAAC | 2645 | GUUCUUCA CUGAUGAGGNNNNNNNNCCGAA AAGCUUCU | 6797 |
| 3266 | AGAACUGUA CAAGGACU | 2646 | AGUCCUUG CUGAUGAGGNNNNNNNNCCGAA ACAGUUCU | 6798 |
| 3275 | CAAGGACUU CCUGACCU | 2647 | AGGUCAGG CUGAUGAGGNNNNNNNNCCGAA AGUCCUUG | 6799 |
| 3276 | AAGGACUUC CUGACCUU | 1962 | AAGGUCAG CUGAUGAGGNNNNNNNNCCGAA AAGUCCUU | 6118 |
| 3284 | CCUGACCUU GGAGCAUC | 1963 | GAUGCUCC CUGAUGAGGNNNNNNNNCCGAA AGGUCAGG | 6119 |
| 3292 | UGGAGCAUC UCAUCUGU | 1964 | ACAGAUGA CUGAUGAGGNNNNNNNNCCGAA AUGCUCCA | 6120 |
| 3294 | GAGCAUCUC AUCUGUUA | 1965 | UAACAGAU CUGAUGAGGNNNNNNNNCCGAA AGAUGCUC | 6121 |
| 3297 | CAUCUCAUC UGUUACAG | 1966 | CUGUAACA CUGAUGAGGNNNNNNNNCCGAA AUGAGAUG | 6122 |
| 3301 | UCAUCUGUU ACAGCUUC | 1967 | GAAGCGUU CUGAUGAGGNNNNNNNNCCGAA ACAGAUGA | 6123 |
| 3302 | CAUCUGUUA CAGCUUCC | 1968 | GGAAGCUG CUGAUGAGGNNNNNNNNCCGAA AACAGAUG | 6124 |
| 3308 | UUACAGCUU CCAAGUGG | 1969 | CCACUUGG CUGAUGAGGNNNNNNNNCCGAA AGCUGUAA | 6125 |
| 3309 | UACAGCUUC CAAGUGGC | 1970 | GCCACUUG CUGAUGAGGNNNNNNNNCCGAA AAGCUGUA | 6126 |
| 3319 | AAGUGGCUA AGGGCAUG | 1971 | CAUGCCCU CUGAUGAGGNNNNNNNNCCGAA AGCCACUU | 6127 |
| 3332 | CAUGGAGUU CUUGGCAU | 1972 | AUGCCAAG CUGAUGAGGNNNNNNNNCCGAA ACUCCAUG | 6128 |
| 3333 | AUGGAGUUC UUGGCAUC | 1973 | GAUGCCAA CUGAUGAGGNNNNNNNNCCGAA AACUCCAU | 6129 |
| 3335 | GGAGUUCUU GGCAUCAA | 2648 | UUGAUGCC CUGAUGAGGNNNNNNNNCCGAA AGAACUCC | 6800 |
| 3341 | CUUGGCAUC AAGGAAGU | 2649 | ACUUCCUU CUGAUGAGGNNNNNNNNCCGAA AUGCCAAG | 6801 |
| 3352 | GGAAGUGUA UCCACAGG | 2650 | CCUGUGGA CUGAUGAGGNNNNNNNNCCGAA ACACUUCC | 6802 |
| 3354 | AAGUGUAUC CACAGGAU | 1977 | UCCCUGUG CUGAUGAGGNNNNNNNNCCGAA AUACACUU | 6133 |
| 3381 | CGAAACAUU CUCCUAUC | 2651 | GAUAGGAG CUGAUGAGGNNNNNNNNCCGAA AUGUUUCG | 6803 |
| 3382 | GAAACAUUC UCCUAUCG | 2652 | CGAUAGGA CUGAUGAGGNNNNNNNNCCGAA AAUGUUUC | 6804 |
| 3384 | AACAUUCUC CUAUCGGA | 2653 | UCCGAUAG CUGAUGAGGNNNNNNNNCCGAA AGAAUGUU | 6805 |
| 3387 | AUUCUCCUA UCGGAGAA | 2654 | UUCUCCGA CUGAUGAGGNNNNNNNNCCGAA AGGAGAAU | 6806 |
| 3389 | UCUCCUAUC GGAGAAGA | 2655 | UCUUCUCC CUGAUGAGGNNNNNNNNCCGAA AUAGGAGA | 6807 |
| 3405 | AAUGUGGUU AAGAUCUG | 2656 | CAGAUCUU CUGAUGAGGNNNNNNNNCCGAA ACCACAUU | 6808 |
| 3406 | AUGUGGUUA AGAUCUGU | 2657 | ACAGAUCU CUGAUGAGGNNNNNNNNCCGAA AACCACAU | 6809 |
| 3411 | GUUAAGAUC UGUGACUU | 2658 | AAGUCACA CUGAUGAGGNNNNNNNNCCGAA AUCUUAAC | 6810 |
| 3419 | CUGUGACUU CGGCUUGG | 2659 | CCAAGCCG CUGAUGAGGNNNNNNNNCCGAA AGUCACAG | 6811 |
| 3420 | UGUGACUUC GGCUUGGC | 2660 | GCCAAGCC CUGAUGAGGNNNNNNNNCCGAA AAGUCACA | 6144 |
| 3425 | CUUCGGCUU GGCCCGGG | 2661 | CCCGGGCC CUGAUGAGGNNNNNNNNCCGAA AGCCGAAG | 6812 |
| 3438 | CGGGACAUU UAUAAAGA | 2662 | UCUUUAUA CUGAUGAGGNNNNNNNNCCGAA AUGUCCCG | 6813 |
| 3439 | GGGACAUUU AUAAAGAC | 2663 | GUCUUUAU CUGAUGAGGNNNNNNNNCCGAA AAUGUCCC | 6814 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3440 | GGACAUUUA UAAAGACC | 2664 | GGUCUUUA CUGAUGAGGNNNNNNNNCCGAA AAAUGUCC | 6815 |
| 3442 | ACAUUUAUA AAGACCCG | 2665 | CGGGUCUU CUGAUGAGGNNNNNNNNCCGAA AUAAAUGU | 6816 |
| 3454 | ACCCGGAUU AUGUCAGA | 2666 | UCUGACAU CUGAUGAGGNNNNNNNNCCGAA AUCCGGGU | 6817 |
| 3455 | CCCGGAUUA UGUCAGAA | 2667 | UUCUGACA CUGAUGAGGNNNNNNNNCCGAA AAUCCGGG | 6818 |
| 3459 | GAUUAUGUC AGAAAAGG | 1998 | CCUUUUCU CUGAUGAGGNNNNNNNNCCGAA ACAUAAUC | 6154 |
| 3480 | GCCCGACUC CCUUUGAA | 2668 | UUCAAAGG CUGAUGAGGNNNNNNNNCCGAA AGUCGGGC | 6819 |
| 3484 | GACUCCCUU UGAAGUGG | 2669 | CCACUUCA CUGAUGAGGNNNNNNNNCCGAA AGGGAGUC | 6820 |
| 3485 | ACUCCCUUU GAAGUGGA | 2670 | UCCACUUC CUGAUGAGGNNNNNNNNCCGAA AAGGGAGU | 6821 |
| 3510 | GAAACCAUU UUUGACAG | 2671 | CUGUCAAA CUGAUGAGGNNNNNNNNCCGAA AUGGUUUC | 6822 |
| 3511 | AAACCAUUU UUGACAGA | 2672 | UCUGUCAA CUGAUGAGGNNNNNNNNCCGAA AAUGGUUU | 6823 |
| 3512 | AACCAUUUU UGACAGAG | 2673 | CUCUGUCA CUGAUGAGGNNNNNNNNCCGAA AAAUGGUU | 6824 |
| 3513 | ACCAUUUUU GACAGAGU | 2674 | ACUCUGUC CUGAUGAGGNNNNNNNNCCGAA AAAAUGGU | 6825 |
| 3522 | GACAGAGUA UACACAAU | 2675 | AUUGUGUA CUGAUGAGGNNNNNNNNCCGAA ACUCUGUC | 6826 |
| 3524 | CAGAGUAUA CACAAUUC | 2676 | GAAUUGUG CUGAUGAGGNNNNNNNNCCGAA AUACUCUG | 6827 |
| 3531 | UACACAAUU CAGAGCGA | 2677 | UCGCUCUG CUGAUGAGGNNNNNNNNCCGAA AUUGUGUA | 6828 |
| 3532 | ACACAAUUC AGAGCGAU | 2678 | AUCGCUCU CUGAUGAGGNNNNNNNNCCGAA AAUUGUGU | 6829 |
| 3548 | UGUGUGGUC UUUCGGUG | 2679 | CACCGAAA CUGAUGAGGNNNNNNNNCCGAA ACCACACA | 6830 |
| 3550 | UGUGGUCUU UCGGUGUG | 2680 | CACACCGA CUGAUGAGGNNNNNNNNCCGAA AGACCACA | 6831 |
| 3551 | GUGGUCUUU CGGUGUGU | 2681 | ACACACCG CUGAUGAGGNNNNNNNNCCGAA AAGACCAC | 6832 |
| 3552 | UGGUCUUUC GGUGUGUU | 2682 | AACACACC CUGAUGAGGNNNNNNNNCCGAA AAAGACCA | 6833 |
| 3560 | CGGUGUGUU GCUCUGGG | 2683 | CCCAGAGC CUGAUGAGGNNNNNNNNCCGAA ACACACCG | 6834 |
| 3564 | GUGUUGCUC UGGGAAAU | 2684 | AUUUCCCA CUGAUGAGGNNNNNNNNCCGAA AGCAACAC | 6835 |
| 3573 | UGGGAAAUA UUUUCCUU | 2017 | AAGGAAAA CUGAUGAGGNNNNNNNNCCGAA AUUUCCCA | 6173 |
| 3575 | GGAAAUAUU UUCCUUAG | 2018 | CUAAGGAA CUGAUGAGGNNNNNNNNCCGAA AUAUUUCC | 6174 |
| 3576 | GAAAUAUUU UCCUUAGG | 2019 | CCUAAGGA CUGAUGAGGNNNNNNNNCCGAA AAUAUUUC | 6175 |
| 3577 | AAAUAUUUU CCUUAGGU | 2020 | ACCUAAGG CUGAUGAGGNNNNNNNNCCGAA AAAUAUUU | 6176 |
| 3578 | AAUAUUUUC CUUAGGUG | 2021 | CACCUAAG CUGAUGAGGNNNNNNNNCCGAA AAAAUAUU | 6177 |
| 3581 | AUUUUCCUU AGGUGCCU | 2685 | AGGCACCU CUGAUGAGGNNNNNNNNCCGAA AGGAAAAU | 6836 |
| 3582 | UUUUCCUUA GGUGCCUC | 2686 | GAGGCACC CUGAUGAGGNNNNNNNNCCGAA AAGGAAAA | 6837 |
| 3590 | AGGUGCCUC CCCAUACC | 2687 | GGUAUGGG CUGAUGAGGNNNNNNNNCCGAA AGGCACCU | 6838 |
| 3596 | CUCCCCAUA CCCUGGGG | 2688 | CCCCAGGG CUGAUGAGGNNNNNNNNCCGAA AUGGGGAG | 6839 |
| 3606 | CCUGGGGUC AAGAUUGA | 2689 | UCAAUCUU CUGAUGAGGNNNNNNNNCCGAA ACCCCAGG | 6185 |
| 3612 | GUCAAGAUU GAUGAAGA | 2690 | UCUUCAUC CUGAUGAGGNNNNNNNNCCGAA AUCUUGAC | 6840 |
| 3623 | UGAAGAAUU UUGUAGGA | 2691 | UCCUACAA CUGAUGAGGNNNNNNNNCCGAA AUUCUUCA | 6841 |
| 3624 | GAAGAAUUU UGUAGGAG | 2692 | CUCCUACA CUGAUGAGGNNNNNNNNCCGAA AAUUCUUC | 6842 |
| 3625 | AAGAAUUUU GUAGGAGA | 2693 | UCUCCUAC CUGAUGAGGNNNNNNNNCCGAA AAAUUCUU | 6843 |
| 3628 | AAUUUUGUA GGAGAUUG | 2694 | CAAUCUCC CUGAUGAGGNNNNNNNNCCGAA ACAAAAUU | 6844 |
| 3635 | UAGGAGAUU GAAAGAAG | 2695 | CUUCUUUC CUGAUGAGGNNNNNNNNCCGAA AUCUCCUA | 6845 |
| 3649 | AAGGAACUA GAAUGCGG | 2696 | CCGCAUUC CUGAUGAGGNNNNNNNNCCGAA AGUUCCUU | 6846 |
| 3661 | UGCGGGCUC CUGACUAC | 2697 | GUAGUCAG CUGAUGAGGNNNNNNNNCCGAA AGCCCGCA | 6847 |
| 3668 | UCCUGACUA CACUACCC | 2698 | GGGUAGUG CUGAUGAGGNNNNNNNNCCGAA AGUCAGGA | 6848 |
| 3673 | ACUACACUA CCCCAGAA | 2699 | UUCUGGGG CUGAUGAGGNNNNNNNNCCGAA AGUGUAGU | 6849 |
| 3686 | AGAAAUGUA CCAGACCA | 2041 | UGGUCUGG CUGAUGAGGNNNNNNNNCCGAA ACAUUUCU | 6197 |
| 3734 | GAGACCCUC GUUUCAG | 2700 | CUGAAAAC CUGAUGAGGNNNNNNNNCCGAA AGGGUCUC | 6850 |
| 3737 | ACCCUCGUU UUCAGAGU | 2701 | ACUCUGAA CUGAUGAGGNNNNNNNNCCGAA ACGAGGGU | 6851 |
| 3738 | CCCUCGUUU UCAGAGUU | 2702 | AACUCUGA CUGAUGAGGNNNNNNNNCCGAA AACGAGGG | 6852 |
| 3739 | CCUCGUUUU CAGAGUUG | 2703 | CAACUCUG CUGAUGAGGNNNNNNNNCCGAA AAACGAGG | 6853 |
| 3740 | CUCGUUUUC AGAGUUGG | 2704 | CCAACUCU CUGAUGAGGNNNNNNNNCCGAA AAAACGAG | 6854 |
| 3746 | UUCAGAGUU GGUGGAGC | 2705 | GCUCCACC CUGAUGAGGNNNNNNNNCCGAA ACUCUGAA | 6855 |
| 3757 | UGGAGCAUU UGGGAAAC | 2706 | GUUUCCCA CUGAUGAGGNNNNNNNNCCGAA AUGCUCCA | 6856 |
| 3758 | GGAGCAUUU GGGAAACC | 2707 | GGUUUCCC CUGAUGAGGNNNNNNNNCCGAA AAUGCUCC | 6857 |
| 3768 | GGAAACCUC CUGCAAGC | 2708 | GCUUGCAG CUGAUGAGGNNNNNNNNCCGAA AGGUUUCC | 6858 |
| 3803 | CAAAGACUA UAUUGUUC | 2709 | GAACAAUA CUGAUGAGGNNNNNNNNCCGAA AGUCUUUG | 6859 |
| 3805 | AAGACUAUA UUGUUCUU | 2710 | AAGAACAA CUGAUGAGGNNNNNNNNCCGAA AUAGUCUU | 6860 |
| 3807 | GACUAUAUU GUUCUUCC | 2711 | GGAAGAAC CUGAUGAGGNNNNNNNNCCGAA AUAUAGUC | 6861 |
| 3810 | UAUAUUGUU CUUCCAAU | 2712 | AUUGGAAG CUGAUGAGGNNNNNNNNCCGAA ACAAUAUA | 6862 |
| 3811 | AUAUUGUUC UUCCAAUG | 2713 | CAUUGGAA CUGAUGAGGNNNNNNNNCCGAA AACAAUAU | 6863 |
| 3813 | AUUGUUCUU CCAAUGUC | 2714 | GACAUUGG CUGAUGAGGNNNNNNNNCCGAA AGAACAAU | 6864 |
| 3814 | UUGUUCUUC CAAUGUCA | 2715 | UGACAUUG CUGAUGAGGNNNNNNNNCCGAA AAGAACAA | 6865 |
| 3821 | UCCAAUGUC AGAGACAC | 2716 | GUGUCUCU CUGAUGAGGNNNNNNNNCCGAA ACAUUGGA | 6866 |
| 3847 | AAGAGGAUU CUGGACUC | 2065 | GAGUCCAG CUGAUGAGGNNNNNNNNCCGAA AUCCUCUU | 6221 |
| 3848 | AGAGGAUUC UGGACUCU | 2066 | AGAGUCCA CUGAUGAGGNNNNNNNNCCGAA AAUCCUCU | 6222 |
| 3855 | UCUGGACUC UCCCUGCC | 2717 | GGCAGGGA CUGAUGAGGNNNNNNNNCCGAA AGUCCAGA | 6867 |
| 3857 | UGGACUCUC CCUGCCUA | 2718 | UAGGCAGG CUGAUGAGGNNNNNNNNCCGAA AGAGUCCA | 6868 |
| 3865 | CCCUGCCUA CCUCACCU | 2719 | AGGUGAGG CUGAUGAGGNNNNNNNNCCGAA AGGCAGGG | 6869 |
| 3869 | GCCUACCUC ACCUGUUU | 2071 | AAACAGGU CUGAUGAGGNNNNNNNNCCGAA AGGUAGGC | 6227 |
| 3876 | UCACCUGUU UCCUGUAU | 2072 | AUACAGGA CUGAUGAGGNNNNNNNNCCGAA ACAGGUGA | 6228 |
| 3877 | CACCUGUUU CCUGUAUG | 2073 | CAUACAGG CUGAUGAGGNNNNNNNNCCGAA AACAGGUG | 6229 |
| 3878 | ACCUGUUUC CUGUAUGG | 2074 | CCAUACAG CUGAUGAGGNNNNNNNNCCGAA AAACAGGU | 6230 |
| 3883 | UUUCCUGUA UGGAGGAA | 2720 | UUCCUCCA CUGAUGAGGNNNNNNNNCCGAA ACAGGAAA | 6870 |
| 3914 | CCCCAAAUU CCAUUAUG | 2077 | CAUAAUGG CUGAUGAGGNNNNNNNNCCGAA AUUUGGGG | 6233 |
| 3915 | CCCAAAUUC CAUUAUGA | 2078 | UCAUAAUG CUGAUGAGGNNNNNNNNCCGAA AAUUUGGG | 6234 |
| 3919 | AAUUCCAUU AUGACAAC | 2079 | GUUGUCAU CUGAUGAGGNNNNNNNNCCGAA AUGGAAUU | 6235 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 3920 | AUUCCAUUA UGACAACA | 2080 | UGUUGUCA CUGAUGAGGNNNNNNNNCCGAA AAUGGAAU | 6236 |
| 3939 | GCAGGAAUC AGUCAUUA | 2721 | UAAUGACU CUGAUGAGGNNNNNNNNCCGAA AUUCCUGC | 6871 |
| 3943 | GAAUCAGUC AUUAUCUC | 2722 | GAGAUAAU CUGAUGAGGNNNNNNNNCCGAA ACUGAUUC | 6872 |
| 3946 | UCAGUCAUU AUCUCCAG | 2723 | CUGGAGAU CUGAUGAGGNNNNNNNNCCGAA AUGACUGA | 6873 |
| 3947 | CAGUCAUUA UCUCCAGA | 2724 | UCUGGAGA CUGAUGAGGNNNNNNNNCCGAA AAUGACUG | 6874 |
| 3949 | GUCAUUAUC UCCAGAAC | 2725 | GUUCUGGA CUGAUGAGGNNNNNNNNCCGAA AUAAUGAC | 6875 |
| 3951 | CAUUAUCUC CAGAACAG | 2726 | CUGUUCUG CUGAUGAGGNNNNNNNNCCGAA AGAUAAUG | 6876 |
| 3961 | AGAACAGUA AGCGAAAG | 2085 | CUUUCGCU CUGAUGAGGNNNNNNNNCCGAA ACUGUUCU | 6241 |
| 3987 | GUGAGUGUA AAAACAUU | 2086 | AAUGUUUU CUGAUGAGGNNNNNNNNCCGAA ACACUCAC | 6242 |
| 3995 | AAAAACAUU UGAAGAUA | 2087 | UAUCUUCA CUGAUGAGGNNNNNNNNCCGAA AUGUUUUU | 6243 |
| 3996 | AAAACAUUU GAAGAUAU | 2088 | AUAUCUUC CUGAUGAGGNNNNNNNNCCGAA AAUGUUUU | 6244 |
| 4003 | UUGAAGAUA UCCCAUUG | 2727 | CAAUGGGA CUGAUGAGGNNNNNNNNCCGAA AUCUUCAA | 6877 |
| 4005 | GAAGAUAUC CCAUUGGA | 2728 | UCCAAUGG CUGAUGAGGNNNNNNNNCCGAA AUAUCUUC | 6878 |
| 4010 | UAUCCCAUU GGAGGAAC | 2729 | GUUCCUCC CUGAUGAGGNNNNNNNNCCGAA AUGGGAUA | 6879 |
| 4026 | CCAGAAGUA AAAGUGAU | 2730 | AUCACUUU CUGAUGAGGNNNNNNNNCCGAA ACUUCUGG | 6880 |
| 4035 | AAAGUGAUC CCAGAUGA | 2731 | UCAUCUGG CUGAUGAGGNNNNNNNNCCGAA AUCACUUU | 6881 |
| 4068 | GGGAUGGUC CUUGCAUC | 2732 | GAUGCAAG CUGAUGAGGNNNNNNNNCCGAA ACCAUCCC | 6882 |
| 4071 | AUGGUCCUU GCAUCAGA | 2733 | UCUGAUGC CUGAUGAGGNNNNNNNNCCGAA AGGACCAU | 6883 |
| 4076 | CCUUGCAUC AGAAGAGC | 2734 | GCUCUUCU CUGAUGAGGNNNNNNNNCCGAA AUGCAAGG | 6884 |
| 4093 | UGAAAACUC UGGAAGAC | 2735 | GUCUUCCA CUGAUGAGGNNNNNNNNCCGAA AGUUUUCA | 6257 |
| 4112 | GAACAAAUU AUCUCCAU | 2736 | AUGGAGAU CUGAUGAGGNNNNNNNNCCGAA AUUUGUUC | 6885 |
| 4113 | AACAAAUUA UCUCCAUC | 2737 | GAUGGAGA CUGAUGAGGNNNNNNNNCCGAA AAUUUGUU | 6886 |
| 4115 | CAAAUUAUC UCCAUCUU | 2105 | AAGAUGGA CUGAUGAGGNNNNNNNNCCGAA AUAAUUUG | 6261 |
| 4117 | AAUUAUCUC CAUCUUUU | 2106 | AAAAGAUG CUGAUGAGGNNNNNNNNCCGAA AGAUAAUU | 6262 |
| 4121 | AUCUCCAUC UUUUGGUG | 2107 | CACCAAAA CUGAUGAGGNNNNNNNNCCGAA AUGGAGAU | 6263 |
| 4123 | CUCCAUCUU UUGGUGGA | 2108 | UCCACCAA CUGAUGAGGNNNNNNNNCCGAA AGAUGGAG | 6264 |
| 4124 | UCCAUCUUU UGGUGGAA | 2109 | UUCCACCA CUGAUGAGGNNNNNNNNCCGAA AAGAUGGA | 6265 |
| 4125 | CCAUCUUUU GGUGGAAU | 2110 | AUUCCACC CUGAUGAGGNNNNNNNNCCGAA AAAGAUGG | 6266 |
| 4144 | UGCCCAGUA AAAGCAGG | 2738 | CCUGCUUU CUGAUGAGGNNNNNNNNCCGAA ACUGGGCA | 6887 |
| 4157 | CAGGGAGUC UGUGGCCU | 2739 | AGGCCACA CUGAUGAGGNNNNNNNNCCGAA ACUCCCUG | 6888 |
| 4166 | UGUGGCCUC GGAAGGCU | 2740 | AGCCUUCC CUGAUGAGGNNNNNNNNCCGAA AGGCCACA | 6889 |
| 4175 | GGAAGGCUC CAACCAGA | 2741 | UCUGGUUG CUGAUGAGGNNNNNNNNCCGAA AGCCUUCC | 6890 |
| 4193 | CAGUGGCUA CCAGUCUG | 2742 | CAGACUGG CUGAUGAGGNNNNNNNNCCGAA AGCCACUG | 6891 |
| 4199 | CUACCAGUC UGGGUAUC | 2743 | GAUACCCA CUGAUGAGGNNNNNNNNCCGAA ACUGGUAG | 6892 |
| 4205 | GUCUGGGUA UCACUCAG | 2744 | CUGAGUGA CUGAUGAGGNNNNNNNNCCGAA ACCCAGAC | 6893 |
| 4207 | CUGGGUAUC ACUCAGAU | 2745 | AUCUGAGU CUGAUGAGGNNNNNNNNCCGAA AUACCCAG | 6894 |
| 4211 | GUAUCACUC AGAUGACA | 2746 | UGUCAUCU CUGAUGAGGNNNNNNNNCCGAA AGUGAUAC | 6895 |
| 4235 | CACCGUGUA CUCCAGCG | 2747 | CGCUGGAG CUGAUGAGGNNNNNNNNCCGAA ACACGGUG | 6896 |
| 4238 | CGUGUACUC CAGCGACG | 2748 | CGUCGCUG CUGAUGAGGNNNNNNNNCCGAA AGUACACG | 6897 |
| 4257 | GCAGGACUU UUAAAGAU | 2749 | AUCUUUAA CUGAUGAGGNNNNNNNNCCGAA AGUCCUGC | 6898 |
| 4258 | CAGGACUUU UAAAGAUG | 2750 | CAUCUUUA CUGAUGAGGNNNNNNNNCCGAA AAGUCCUG | 6899 |
| 4259 | AGGACUUUU AAAGAUGG | 2751 | CCAUCUUU CUGAUGAGGNNNNNNNNCCGAA AAAGUCCU | 6900 |
| 4260 | GGACUUUUA AAGAUGGU | 2752 | ACCAUCUU CUGAUGAGGNNNNNNNNCCGAA AAAAGUCC | 6901 |
| 4281 | GCUGCAGUU CACGCUGA | 2753 | UCAGCGUG CUGAUGAGGNNNNNNNNCCGAA ACUGCAGC | 6902 |
| 4282 | CUGCAGUUC ACGCUGAC | 2754 | GUCAGCGU CUGAUGAGGNNNNNNNNCCGAA AACUGCAG | 6903 |
| 4292 | CGCUGACUC AGGGACCA | 2755 | UGGUCCCU CUGAUGAGGNNNNNNNNCCGAA AGUCAGCG | 6904 |
| 4311 | CUGCAGCUC ACCUCCUG | 2756 | CAGGAGGU CUGAUGAGGNNNNNNNNCCGAA AGCUGCAG | 6905 |
| 4316 | GCUCACCUC CUGUUUAA | 2757 | UUAAACAG CUGAUGAGGNNNNNNNNCCGAA AGGUGAGC | 6906 |
| 4321 | CCUCCUGUU AAAUGGA | 2758 | UCCAUUUA CUGAUGAGGNNNNNNNNCCGAA ACAGGAGG | 6907 |
| 4322 | CUCCUGUUU AAAUGGAA | 2759 | UUCCAUUU CUGAUGAGGNNNNNNNNCCGAA AACAGGAG | 6908 |
| 4323 | UCCUGUUUA AAUGGAAG | 2760 | CUUCCAUU CUGAUGAGGNNNNNNNNCCGAA AAACAGGA | 6909 |
| 4336 | GAAGUGGUC CUGUCCCG | 2761 | CGGGACAG CUGAUGAGGNNNNNNNNCCGAA ACCACUUC | 6910 |
| 4341 | GGUCCUGUC CCGGCUCC | 2762 | GGAGCCGG CUGAUGAGGNNNNNNNNCCGAA ACAGGACC | 6911 |
| 4348 | UCCCGGCUC CGCCCCCA | 2763 | UGGGGGCG CUGAUGAGGNNNNNNNNCCGAA AGCCGGGA | 6912 |
| 4360 | CCCCAACUC UGGAAAU | 2764 | AUUUCCAG CUGAUGAGGNNNNNNNNCCGAA AGUGGGG | 6913 |
| 4369 | CUGGAAAUC ACGAGAGA | 2765 | UCUCUCGU CUGAUGAGGNNNNNNNNCCGAA AUUUCCAG | 6914 |
| 4387 | GUGCUGCUU AGAUUUUC | 2766 | GAAAAUCU CUGAUGAGGNNNNNNNNCCGAA AGCAGCAC | 6915 |
| 4388 | UGCUGCUUA GAUUUUCA | 2767 | UGAAAAUC CUGAUGAGGNNNNNNNNCCGAA AAGCAGCA | 6916 |
| 4392 | GCUUAGAUU UCAAGUG | 2768 | CACUUGAA CUGAUGAGGNNNNNNNNCCGAA AUCUAAGC | 6917 |
| 4393 | CUUAGAUUU UCAAGUGU | 2769 | ACACUUGA CUGAUGAGGNNNNNNNNCCGAA AAUCUAAG | 6918 |
| 4394 | UUAGAUUUU CAAGUGUU | 2770 | AACACUUG CUGAUGAGGNNNNNNNNCCGAA AAAUCUAA | 6919 |
| 4395 | UAGAUUUUC AAGUGUUG | 2771 | CAACACUU CUGAUGAGGNNNNNNNNCCGAA AAAAUCUA | 6920 |
| 4402 | UCAAGUGUU GUUCUUUC | 2772 | GAAAGAAC CUGAUGAGGNNNNNNNNCCGAA ACACUUGA | 6921 |
| 4405 | AGUGUUGUU CUUCCAC | 2146 | GUGGAAAG CUGAUGAGGNNNNNNNNCCGAA ACAACACU | 6302 |
| 4406 | GUGUUGUUC UUUCCACC | 2147 | GGUGGAAA CUGAUGAGGNNNNNNNNCCGAA AACAACAC | 6303 |
| 4408 | GUUGUUCUU UCCACCAC | 2773 | GUGGUGGA CUGAUGAGGNNNNNNNNCCGAA AGAACAAC | 6922 |
| 4409 | UUGUUCUUU CCACCACC | 2774 | GGUGGUGG CUGAUGAGGNNNNNNNNCCGAA AAGAACAA | 6923 |
| 4410 | UGUUCUUUC CACCACCC | 2775 | GGGUGGUG CUGAUGAGGNNNNNNNNCCGAA AAAGAACA | 6924 |
| 4425 | CCGGAAGUA GCCACAUU | 2776 | AAUGUGGC CUGAUGAGGNNNNNNNNCCGAA ACUUCCGG | 6925 |
| 4433 | AGCCACAUU UGAUUUUC | 2777 | GAAAAUCA CUGAUGAGGNNNNNNNNCCGAA AUGUGGCU | 6926 |
| 4434 | GCCACAUUU GAUUUUCA | 2778 | UGAAAAUC CUGAUGAGGNNNNNNNNCCGAA AAUGUGGC | 6927 |
| 4438 | CAUUUGAUU UUCAUUUU | 2779 | AAAAUGAA CUGAUGAGGNNNNNNNNCCGAA AUCAAAUG | 6928 |
| 4439 | AUUUGAUUU UCAUUUUU | 2780 | AAAAAUGA CUGAUGAGGNNNNNNNNCCGAA AAUCAAAU | 6929 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4440 | UUUGAUUUU CAUUUUUG | 2781 | CAAAAAUG CUGAUGAGGNNNNNNNNCCGAA AAAUCAAA | 6930 |
| 4441 | UUGAUUUUC AUUUUUGG | 2782 | CCAAAAAU CUGAUGAGGNNNNNNNNCCGAA AAAAUCAA | 6931 |
| 4444 | AUUUUCAUU UUUGGAGG | 2783 | CCUCCAAA CUGAUGAGGNNNNNNNNCCGAA AUGAAAAU | 6932 |
| 4445 | UUUUCAUUU UUGGAGGA | 2784 | UCCUCCAA CUGAUGAGGNNNNNNNNCCGAA AAUGAAAA | 6933 |
| 4446 | UUUCAUUUU UGGAGGAG | 2785 | CUCCUCCA CUGAUGAGGNNNNNNNNCCGAA AAAUGAAA | 6934 |
| 4447 | UUCAUUUUU GGAGGAGG | 2786 | CCUCCUCC CUGAUGAGGNNNNNNNNCCGAA AAAAUGAA | 6935 |
| 4461 | AGGGACCUC AGACUGCA | 2787 | UGCAGUCU CUGAUGAGGNNNNNNNNCCGAA AGGUCCCU | 6936 |
| 4477 | AAGGAGCUU GUCCUCAG | 2788 | CUGAGGAC CUGAUGAGGNNNNNNNNCCGAA AGCUCCUU | 6937 |
| 4480 | GAGCUUGUC CUCAGGGC | 2789 | GCCCUGAG CUGAUGAGGNNNNNNNNCCGAA ACAAGCUC | 6938 |
| 4483 | CUUGUCCUC AGGGCAUU | 2790 | AAUGCCCU CUGAUGAGGNNNNNNNNCCGAA AGGACAAG | 6939 |
| 4491 | CAGGGCAUU UCCAGAGA | 2791 | UCUCUGGA CUGAUGAGGNNNNNNNNCCGAA AUGCCCUG | 6940 |
| 4492 | AGGGCAUUU CCAGAGAA | 2792 | UUCUCUGG CUGAUGAGGNNNNNNNNCCGAA AAUGCCCU | 6941 |
| 4493 | GGGCAUUUC CAGAGAAG | 2793 | CUUCUCUG CUGAUGAGGNNNNNNNNCCGAA AAAUGCCC | 6942 |
| 4528 | GAAUGUGUU GACUCUAC | 2794 | GUAGAGUC CUGAUGAGGNNNNNNNNCCGAA ACACAUUC | 6943 |
| 4530 | UGUUGACUC UACUCUCU | 2795 | AGAGAGUA CUGAUGAGGNNNNNNNNCCGAA AGUCAACA | 6944 |
| 4532 | UUGACUCUA CUCUCUUU | 2796 | AAAGAGAG CUGAUGAGGNNNNNNNNCCGAA AGAGUCAA | 6945 |
| 4535 | ACUCUACUC UCUUUCC | 2797 | GGAAAAGA CUGAUGAGGNNNNNNNNCCGAA AGUAGAGU | 6946 |
| 4537 | UCUACUCUC UUUUCCAU | 2798 | AUGGAAAA CUGAUGAGGNNNNNNNNCCGAA AGAGUAGA | 6947 |
| 4539 | UACUCUCUU UUCCAUUC | 2799 | GAAUGGAA CUGAUGAGGNNNNNNNNCCGAA AGAGAGUA | 6948 |
| 4540 | ACUCUCUUU UCCAUUCA | 2800 | UGAAUGGA CUGAUGAGGNNNNNNNNCCGAA AAGAGAGU | 6949 |
| 4541 | CUCUCUUUU CCAUUCAU | 2801 | AUGAAUGG CUGAUGAGGNNNNNNNNCCGAA AAAGAGAG | 6950 |
| 4542 | UCUCUUUUC CAUUCAUU | 2802 | AAUGAAUG CUGAUGAGGNNNNNNNNCCGAA AAAAGAGA | 6951 |
| 4546 | UUUUCCAUU CAUUUAAA | 2803 | UUUAAAUG CUGAUGAGGNNNNNNNNCCGAA AUGGAAAA | 6952 |
| 4547 | UUUCCAUUC AUUUAAAA | 2804 | UUUUAAAU CUGAUGAGGNNNNNNNNCCGAA AAUGGAAA | 6953 |
| 4550 | CCAUUCAUU UAAAAGUC | 2805 | GACUUYUA CUGAUGAGGNNNNNNNNCCGAA AUGAAUGG | 6954 |
| 4551 | CAUUCAUUU AAAAGUCC | 2806 | GGACUUUU CUGAUGAGGNNNNNNNNCCGAA AAUGAAUG | 6955 |
| 4552 | AUUCAUUUA AAAGUCCU | 2807 | AGGACUUU CUGAUGAGGNNNNNNNNCCGAA AAAUGAAU | 6956 |
| 4558 | UUAAAAGUC CUAUAUAA | 2808 | UUAUAUAG CUGAUGAGGNNNNNNNNCCGAA ACUUUUAA | 6957 |
| 4561 | AAAGUCCUA UAUAAUGU | 2809 | ACAUUAUA CUGAUGAGGNNNNNNNNCCGAA AGGACUUU | 6958 |
| 4563 | AGUCCUAUA UAAUGUGC | 2810 | GCACAUUA CUGAUGAGGNNNNNNNNCCGAA AUAGGACU | 6959 |
| 4565 | UCCUAUAUA AUGUGCCC | 2811 | GGGCACAU CUGAUGAGGNNNNNNNNCCGAA AUAUAGGA | 6960 |
| 4583 | GCUGUGGUC UCACUACC | 2812 | GGUAGUGA CUGAUGAGGNNNNNNNNCCGAA ACCACAGC | 6961 |
| 4585 | UGUGGUCUC ACUACCAG | 2813 | CUGGUAGU CUGAUGAGGNNNNNNNNCCGAA AGACCACA | 6962 |
| 4589 | GUCUCACUA CCAGUUAA | 2814 | UUAACUGG CUGAUGAGGNNNNNNNNCCGAA AGUGAGAC | 6963 |
| 4595 | CUACCAGUU AAAGCAAA | 2815 | UUUGCUUU CUGAUGAGGNNNNNNNNCCGAA ACUGGUAG | 6964 |
| 4596 | UACCAGUUA AAGCAAAA | 2816 | UUUUGCUU CUGAUGAGGNNNNNNNNCCGAA AACUGGUA | 696S |
| 4609 | AAAAGACUU UCAAACAC | 2817 | GUGUUUGA CUGAUGAGGNNNNNNNNCCGAA AGUCUUUU | 6966 |
| 4610 | AAAGACUUU CAAACACG | 2818 | CGUGUUUG CUGAUGAGGNNNNNNNNCCGAA AAGUCUUU | 6967 |
| 4611 | AAGACUUUC AAACACGU | 2819 | ACGUGUUU CUGAUGAGGNNNNNNNNCCGAA AAAGUCUU | 6968 |
| 4625 | CGUGGACUC UGUCCUCC | 2820 | GGAGGACA CUGAUGAGGNNNNNNNNCCGAA AGUCCACG | 6969 |
| 4629 | GACUCUGUC CUCCAAGA | 2821 | UCUUGGAG CUGAUGAGGNNNNNNNNCCGAA ACAGAGUC | 6970 |
| 4632 | UCUGUCCUC CAAGAAGU | 2822 | ACUUCUUG CUGAUGAGGNNNNNNNNCCGAA AGGACAGA | 6971 |
| 4654 | CGGCACCUC UGUGAAAC | 2823 | GUUUCACA CUGAUGAGGNNNNNNNNCCGAA AGGUGCCG | 6972 |
| 4668 | AACUGGAUC GAAUGGGC | 2824 | GCCCAUUC CUGAUGAGGNNNNNNNNCCGAA AUCCAGUU | 6973 |
| 4683 | GCAAUGCUU UGUGUGUU | 2825 | AACACACA CUGAUGAGGNNNNNNNNCCGAA AGCAUUGC | 6974 |
| 4684 | CAAUGCUUU GUGUGUUG | 2826 | CAACACAC CUGAUGAGGNNNNNNNNCCGAA AAGCAUUG | 6975 |
| 4691 | UUGUGUGUU GAGGAUGG | 2827 | CCAUCCUC CUGAUGAGGNNNNNNNNCCGAA ACACACAA | 6976 |
| 4709 | UGAGAUGUC CCAGGGCC | 2828 | GGCCCUGG CUGAUGAGGNNNNNNNNCCGAA ACAUCUCA | 6977 |
| 4722 | GGCCGAGUC UGUCUACC | 2829 | GGUAGACA CUGAUGAGGNNNNNNNNCCGAA ACUCGGCC | 6978 |
| 4726 | GAGUCUGUC UACCUUGG | 2830 | CCAAGGUA CUGAUGAGGNNNNNNNNCCGAA ACAGACUC | 6979 |
| 4728 | GUCUGUCUA CCUUGGAG | 2831 | CUCCAAGG CUGAUGAGGNNNNNNNNCCGAA AGACAGAC | 6980 |
| 4732 | GUCUACCUU GGAGGCUU | 2832 | AAGCCUCC CUGAUGAGGNNNNNNNNCCGAA AGGUAGAC | 6981 |
| 4740 | UGGAGGCUU UGUGGAGG | 2833 | CCUCCACA CUGAUGAGGNNNNNNNNCCGAA AGCCUCCA | 6982 |
| 4741 | GGAGGCUUU GUGGAGGA | 2834 | UCCUCCAC CUGAUGAGGNNNNNNNNCCGAA AAGCCUCC | 6983 |
| 4758 | UGCGGGCUA UGAGCCAA | 2835 | UUGGCUCA CUGAUGAGGNNNNNNNNCCGAA AGCCCGCA | 6984 |
| 4771 | CCAAGUGUU AAGUGUGG | 2836 | CCACACUU CUGAUGAGGNNNNNNNNCCGAA ACACUUGG | 6985 |
| 4772 | CAAGUGUUA AGUGUGGG | 2837 | CCCACACU CUGAUGAGGNNNNNNNNCCGAA AACACUUG | 6986 |
| 4811 | GCGCAAGUC GCUCGGAG | 2838 | CUCCGAGC CUGAUGAGGNNNNNNNNCCGAA ACUUGCGC | 6987 |
| 4815 | AAGUCGCUC GGAGAGCG | 2839 | CGCUCUCC CUGAUGAGGNNNNNNNNCCGAA AGCGACUU | 6988 |
| 4826 | AGAGCGGUU GGAGCCUG | 2840 | CAGGCUCC CUGAUGAGGNNNNNNNNCCGAA ACCGCUCU | 6989 |
| 4844 | AGAUGCAUU GUGCUGGC | 2841 | GCCAGCAC CUGAUGAGGNNNNNNNNCCGAA AUGCAUCU | 6990 |
| 4854 | UGCUGGCUC UGGUGGAG | 2842 | CUCCACCA CUGAUGAGGNNNNNNNNCCGAA AGCCAGCA | 6991 |
| 4870 | GGUGGGCUU GUGGCCUG | 2843 | CAGGCCAC CUGAUGAGGNNNNNNNNCCGAA AGCCCACC | 6992 |
| 4880 | UGGCCUGUC AGGAAACG | 2844 | CGUUUCCU CUGAUGAGGNNNNNNNNCCGAA ACAGGCCA | 6993 |
| 4908 | GGCAGGGUU UGGUUUUG | 2845 | CAAAACCA CUGAUGAGGNNNNNNNNCCGAA ACCCUGCC | 6994 |
| 4909 | GCAGGGUUU GGUUUUGG | 2846 | CCAAAACC CUGAUGAGGNNNNNNNNCCGAA AACCCUGC | 6995 |
| 4913 | GGUUUGGUU UUGGAAGG | 2847 | CCUUCCAA CUGAUGAGGNNNNNNNNCCGAA ACCAAACC | 6996 |
| 4914 | GUUUGGUUU UGGAAGGU | 2848 | ACCUUCCA CUGAUGAGGNNNNNNNNCCGAA AACCAAAC | 6997 |
| 4915 | UUUGGUUUU GGAAGGUU | 2849 | AACCUUCC CUGAUGAGGNNNNNNNNCCGAA AAACCAAA | 6998 |
| 4923 | UGGAAGGUU UGCGUGCU | 2850 | AGCACGCA CUGAUGAGGNNNNNNNNCCGAA ACCUUCCA | 6999 |
| 4924 | GGAAGGUUU GCGUGCUC | 2851 | GAGCACGC CUGAUGAGGNNNNNNNNCCGAA AACCUUCC | 7000 |
| 4932 | UGCGUGCUC UUCACAGU | 2852 | ACUGUGAA CUGAUGAGGNNNNNNNNCCGAA AGCACGCA | 7001 |
| 4934 | CGUGCUCUU CACAGUCG | 2853 | CGACUGUG CUGAUGAGGNNNNNNNNCCGAA AGAGCACG | 7002 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 4935 | GUGCUCUUC ACAGUCGG | 2854 | CCGACUGU CUGAUGAGGNNNNNNNNCCGAA AAGAGCAC | 7003 |
| 4941 | UUCACAGUC GGGUUACA | 2855 | UGUAACCC CUGAUGAGGNNNNNNNNCCGAA ACUGUGAA | 7004 |
| 4946 | AGUCGGGUU ACAGGCGA | 2856 | UCGCCUGU CUGAUGAGGNNNNNNNNCCGAA ACCCGACU | 7005 |
| 4947 | GUCGGGUUA CAGGCGAG | 2857 | CUCGCCUG CUGAUGAGGNNNNNNNNCCGAA AACCCGAC | 7006 |
| 4957 | AGGCGAGUU CCCUGUGG | 2858 | CCACAGGG CUGAUGAGGNNNNNNNNCCGAA ACUCGCCU | 7007 |
| 4958 | GGCGAGUUC CCUGUGGC | 2859 | GCCACAGG CUGAUGAGGNNNNNNNNCCGAA AACUCGCC | 7008 |
| 4969 | UGUGGCGUU UCCUACUC | 2860 | GAGUAGGA CUGAUGAGGNNNNNNNNCCGAA ACGCCACA | 7009 |
| 4970 | GUGGCGUUU CCUACUCC | 2861 | GGAGUAGG CUGAUGAGGNNNNNNNNCCGAA AACGCCAC | 7010 |
| 4971 | UGGCGUUUC CUACUCCU | 2862 | AGGAGUAG CUGAUGAGGNNNNNNNNCCGAA AAACGCCA | 7011 |
| 4974 | CGUUUCCUA CUCCUAAU | 2863 | AUUAGGAG CUGAUGAGGNNNNNNNNCCGAA AGGAAACG | 7012 |
| 4977 | UUCCUACUC CUAAUGAG | 2864 | CUCAUUAG CUGAUGAGGNNNNNNNNCCGAA AGUAGGAA | 7013 |
| 4980 | CUACUCCUA AUGAGAGU | 2865 | ACUCUCAU CUGAUGAGGNNNNNNNNCCGAA AGGAGUAG | 7014 |
| 4989 | AUGAGAGUU CCUUCCGG | 2866 | CCGGAAGG CUGAUGAGGNNNNNNNNCCGAA ACUCUCAU | 7015 |
| 4990 | UGAGAGUUC CUUCCGGA | 2867 | UCCGGAAG CUGAUGAGGNNNNNNNNCCGAA AACUCUCA | 7016 |
| 4993 | GAGUUCCUU CCGGACUC | 2868 | GAGUCCGG CUGAUGAGGNNNNNNNNCCGAA AGGAACUC | 7017 |
| 4994 | AGUUCCUUC CGGACUCU | 2869 | AGAGUCCG CUGAUGAGGNNNNNNNNCCGAA AAGGAACU | 7018 |
| 5001 | UCCGGACUC UUACGUGU | 2870 | ACACGUAA CUGAUGAGGNNNNNNNNCCGAA AGUCCGGA | 7019 |
| 5003 | CGGACUCUU ACGUGUCU | 2871 | AGACACGU CUGAUGAGGNNNNNNNNCCGAA AGAGUCCG | 7020 |
| 5004 | GGACUCUUA CGUGUCUC | 2872 | GAGACACG CUGAUGAGGNNNNNNNNCCGAA AAGAGUCC | 7021 |
| 5010 | UUACGUGUC UCCUGGCC | 2873 | GGCCAGGA CUGAUGAGGNNNNNNNNCCGAA ACACGUAA | 7022 |
| 5012 | ACGUGUCUC CUGGCCUG | 2874 | CAGGCCAG CUGAUGAGGNNNNNNNNCCGAA AGACACGU | 7023 |
| 5046 | AUGCAGCUU GCUCCUUC | 2875 | GAAGGAGC CUGAUGAGGNNNNNNNNCCGAA AAGCUGCAU | 7024 |
| 5050 | AGCUUGCUC CUUCCUCA | 2876 | UGAGGAAG CUGAUGAGGNNNNNNNNCCGAA AGCAAGCU | 7025 |
| 5053 | UUGCUCCUU CCUCAUCU | 2877 | AGAUGAGG CUGAUGAGGNNNNNNNNCCGAA AGGAGCAA | 7026 |
| 5054 | UGCUCCUUC CUCAUCUC | 2878 | GAGAUGAG CUGAUGAGGNNNNNNNNCCGAA AAGGAGCA | 7027 |
| 5057 | UCCUUCCUC AUCUCUCA | 2879 | UGAGAGAU CUGAUGAGGNNNNNNNNCCGAA AGGAAGGA | 7028 |
| 5060 | UUCCUCAUC UCUCAGGC | 2880 | GCCUGAGA CUGAUGAGGNNNNNNNNCCGAA AUGAGGAA | 7029 |
| 5062 | CCUCAUCUC UCAGGCUG | 2881 | CAGCCUGA CUGAUGAGGNNNNNNNNCCGAA AGAUGAGG | 7030 |
| 5064 | UCAUCUCUC AGGCUGUG | 2882 | CACAGCCU CUGAUGAGGNNNNNNNNCCGAA AGAGAUGA | 7031 |
| 5076 | CUGUGCCUU AAUUCAGA | 2883 | UCUGAAUU CUGAUGAGGNNNNNNNNCCGAA AGGCACAG | 7032 |
| 5077 | UGUGCCUUA AUUCAGAA | 2884 | UUCUGAAU CUGAUGAGGNNNNNNNNCCGAA AAGGCACA | 7033 |
| 5080 | GCCUUAAUU CAGAACAC | 2885 | GUGUUCUG CUGAUGAGGNNNNNNNNCCGAA AUUAAGGC | 7034 |
| 5081 | CCUUAAUUC AGAACACC | 2886 | GGUGUUCU CUGAUGAGGNNNNNNNNCCGAA AAUUAAGG | 7035 |
| 5105 | AGGAACGUC GGCAGAGG | 2887 | CCUCUGCC CUGAUGAGGNNNNNNNNCCGAA ACGUUCCU | 7036 |
| 5116 | CAGAGGCUC CUGACGGG | 2888 | CCCGUCAG CUGAUGAGGNNNNNNNNCCGAA AGCCUCUG | 7037 |
| 5135 | CGAAGAAUU GUGAGAAC | 2889 | GUUCUCAC CUGAUGAGGNNNNNNNNCCGAA AUUCUUCG | 7038 |
| 5156 | CAGAAACUC AGGGUUUC | 2890 | GAAACCCU CUGAUGAGGNNNNNNNNCCGAA AGUUUCUG | 7039 |
| 5162 | CUCAGGGUU UCUGCUGG | 2891 | CCAGCAGA CUGAUGAGGNNNNNNNNCCGAA ACCCUGAG | 7040 |
| 5163 | UCAGGGUUU CUGCUGGG | 2892 | CCCAGCAG CUGAUGAGGNNNNNNNNCCGAA AACCCUGA | 7041 |
| 5164 | CAGGGUUUC UGCUGGGU | 2893 | ACCCAGCA CUGAUGAGGNNNNNNNNCCGAA AAACCCUG | 7042 |
| 5203 | UGGCAGGUC UGAGGGUU | 2894 | AACCCUCA CUGAUGAGGNNNNNNNNCCGAA ACCUGCCA | 7043 |
| 5211 | CUGAGGGUU CUCUGUCA | 2895 | UGACAGAG CUGAUGAGGNNNNNNNNCCGAA ACCCUCAG | 7044 |
| 5212 | UGAGGGUUC UCUGUCAA | 2896 | UUGACAGA CUGAUGAGGNNNNNNNNCCGAA AACCCUCA | 7045 |
| 5214 | AGGGUUCUC UGUCAAGU | 2897 | ACUUGACA CUGAUGAGGNNNNNNNNCCGAA AGAACCCU | 7046 |
| 5218 | UUCUCUGUC AAGUGGCG | 2898 | CGCCACUU CUGAUGAGGNNNNNNNNCCGAA ACAGAGAA | 7047 |
| 5229 | GUGGCGGUA AAGGCUCA | 2899 | UGAGCCUU CUGAUGAGGNNNNNNNNCCGAA ACCGCCAC | 7048 |
| 5226 | UAAAGGCUC AGGCAGGU | 2900 | ACCAGCCU CUGAUGAGGNNNNNNNNCCGAA AGCCUUUA | 7049 |
| 5247 | GCUGGUGUU CUUCCUCU | 2901 | AGAGGAAG CUGAUGAGGNNNNNNNNCCGAA ACACCAGC | 7050 |
| 5248 | CUGGUGUUC UUCCUCUA | 2902 | UAGAGGAA CUGAUGAGGNNNNNNNNCCGAA AACACCAG | 7051 |
| 5250 | GGUGUUCUU CCUCUAUC | 2903 | GAUAGAGG CUGAUGAGGNNNNNNNNCCGAA AGAACACC | 7052 |
| 5251 | GUGUUCUUC CUCUAUCU | 2904 | AGAUAGAG CUGAUGAGGNNNNNNNNCCGAA AAGAACAC | 7053 |
| 5254 | UUCUUCCUC UAUCUCCA | 2905 | UGGAGAUA CUGAUGAGGNNNNNNNNCCGAA AGGAAGAA | 7054 |
| 5256 | CUUCCUCUA UCUCCACU | 2906 | AGUGGAGA CUGAUGAGGNNNNNNNNCCGAA AGAGGAAG | 7055 |
| 5258 | UCCUCUAUC UCCACUCC | 2907 | GGAGUGGA CUGAUGAGGNNNNNNNNCCGAA AUAGGAGA | 7056 |
| 5260 | CUCUAUCUC CACUCCUG | 2908 | CAGGAGUG CUGAUGAGGNNNNNNNNCCGAA AGAUAGAG | 7057 |
| 5265 | UCUCCACUC CUGUCAGG | 2909 | CCUGACAG CUGAUGAGGNNNNNNNNCCGAA AGUGGAGA | 7058 |
| 5270 | ACUCCUGUC AGGCCCCC | 2910 | GGGGGCCU CUGAUGAGGNNNNNNNNCCGAA ACAGGAGU | 7059 |
| 5283 | CCCCAAGUC UCAGUAU | 2911 | AUACUGAG CUGAUGAGGNNNNNNNNCCGAA ACUUGGGG | 7060 |
| 5286 | CAAGUCCUC AGUAUUUU | 2912 | AAAAUACU CUGAUGAGGNNNNNNNNCCGAA AGGACUUG | 7061 |
| 5290 | UCCUCAGUA UUUUAGCU | 2913 | AGCUAAAA CUGAUGAGGNNNNNNNNCCGAA ACUGAGGA | 7062 |
| 5292 | CUCAGUAUU UUAGCUUU | 2914 | AAAGCUAA CUGAUGAGGNNNNNNNNCCGAA AUACUGAG | 7063 |
| 5293 | UCAGUAUUU UAGCUUUG | 2915 | CAAAGCUA CUGAUGAGGNNNNNNNNCCGAA AAUACUGA | 7064 |
| 5294 | CAGUAUUUU AGCUUUGU | 2916 | ACAAAGCU CUGAUGAGGNNNNNNNNCCGAA AAAUACUG | 7065 |
| 5295 | AGUAUUUUA GCUUUGUG | 2917 | CACAAAGC CUGAUGAGGNNNNNNNNCCGAA AAAAUACU | 7066 |
| 5299 | UUUUAGCUU UGUGGCUU | 2918 | AAGCCACA CUGAUGAGGNNNNNNNNCCGAA AGCUAAAA | 7067 |
| 5300 | UUUAGCUUU GUGGCUUC | 2919 | GAAGCCAC CUGAUGAGGNNNNNNNNCCGAA AAGCUAAA | 7068 |
| 5307 | UUGUGGCUU CCUGAUGG | 2920 | CCAUCAGG CUGAUGAGGNNNNNNNNCCGAA AGCCACAA | 7069 |
| 5308 | UGUGGCUUC CUGAUGGC | 2921 | GCCAUCAG CUGAUGAGGNNNNNNNNCCGAA AAGCCACA | 7070 |
| 5325 | AGAAAAAUC UUAAUUGG | 2922 | CCAAUUAA CUGAUGAGGNNNNNNNNCCGAA AUUUUUCU | 7071 |
| 5327 | AAAAAUCUU AAUGGUU | 2923 | AACCAAUU CUGAUGAGGNNNNNNNNCCGAA AGAUUUUU | 7072 |
| 5328 | AAAAUCUUA AUGGUUG | 2924 | CAACCAAU CUGAUGAGGNNNNNNNNCCGAA AAGAUUUU | 7073 |
| 5331 | AUCUUAAUU GGUUGGUU | 2925 | AACCAACC CUGAUGAGGNNNNNNNNCCGAA AUUAAGAU | 7074 |
| 5335 | UAAUUGGUU GGUUUGCU | 2926 | AGCAAACC CUGAUGAGGNNNNNNNNCCGAA ACCAAUUA | 7075 |

TABLE VI-continued

Mouse flk-1 VEGF Receptor-Hammerhead Ribozyme and Substrate Sequence

| Pos | Substrate | Seq ID No | HH Ribozyme Sequence | Seq ID No |
|---|---|---|---|---|
| 5339 | UGGUUGGUU UGCUCUCC | 2927 | GGAGAGCA CUGAUGAGGNNNNNNNNCCGAA ACCAACCA | 7076 |
| 5340 | GGUUGGUUU GCUCUCCA | 2928 | UGGAGAGC CUGAUGAGGNNNNNNNNCCGAA AACCAACC | 7077 |
| 5344 | GGUUUGCUC UCCAGAUA | 2929 | UAUCUGGA CUGAUGAGGNNNNNNNNCCGAA AGCAAACC | 7078 |
| 5346 | UUUGCUCUC CAGAUAAU | 2930 | AUUAUCUG CUGAUGAGGNNNNNNNNCCGAA AGAGCAAA | 7079 |
| 5352 | CUCCAGAUA AUCACUAG | 2931 | CUAGUGAU CUGAUGAGGNNNNNNNNCCGAA AUCUGGAG | 7080 |
| 5355 | CAGAUAAUC ACUAGCCA | 2932 | UGGCUAGU CUGAUGAGGNNNNNNNNCCGAA AUUAUCUG | 7081 |
| 5359 | UAAUCACUA GCCAGAUU | 2933 | AAUCUGGC CUGAUGAGGNNNNNNNNCCGAA AGUGAUUA | 7082 |
| 5367 | AGCCAGAUU UCGAAAUU | 2934 | AAUUUCGA CUGAUGAGGNNNNNNNNCCGAA AUCUGGCU | 7083 |
| 5368 | GCCAGAUUU CGAAAUUA | 2935 | UAAUUUCG CUGAUGAGGNNNNNNNNCCGAA AAUCUGGC | 7084 |
| 5369 | CCAGAUUUC GAAAUUAC | 2936 | GUAAUUUC CUGAUGAGGNNNNNNNNCCGAA AAAUCUGG | 7085 |
| 5375 | UUCGAAAUU ACUUUUUA | 2937 | UAAAAAGU CUGAUGAGGNNNNNNNNCCGAA AUUUCGAA | 7086 |
| 5376 | UCGAAAUUA CUUUUUAG | 2938 | CUAAAAAG CUGAUGAGGNNNNNNNNCCGAA AAUUUCGA | 7087 |
| 5379 | AAAUUACUU UUUAGCCG | 2939 | CGGCUAAA CUGAUGAGGNNNNNNNNCCGAA AGUAAUUU | 7088 |
| 5380 | AAUUACUUU UUAGCCGA | 2940 | UCGGCUAA CUGAUGAGGNNNNNNNNCCGAA AAGUAAUU | 7089 |
| 5381 | AUUACUUUU UAGCCGAG | 2941 | CUCGGCUA CUGAUGAGGNNNNNNNNCCGAA AAAGUAAU | 7090 |
| 5382 | UUACUUUUU AGCCGAGG | 2942 | CCUCGGCU CUGAUGAGGNNNNNNNNCCGAA AAAAGUAA | 7091 |
| 5383 | UACUUUUUA GCCGAGGU | 2943 | ACCUCGGC CUGAUGAGGNNNNNNNNCCGAA AAAAAGUA | 7092 |
| 5392 | GCCGAGGUU AUGAUAAC | 2944 | GUUAUCAU CUGAUGAGGNNNNNNNNCCGAA ACCUCGGC | 7093 |
| 5393 | CCGAGGUUA UGAUAACA | 2945 | UGUUAUCA CUGAUGAGGNNNNNNNNCCGAA AACCUCGG | 7094 |
| 5398 | GUUAUGAUA ACAUCUAC | 2946 | GUAGAUGU CUGAUGAGGNNNNNNNNCCGAA AUCAUAAC | 7095 |
| 5403 | GAUAACAUC UACUGUAU | 2947 | AUACAGUA CUGAUGAGGNNNNNNNNCCGAA AUGUUAUC | 7096 |
| 5405 | UAACAUCUA CUGUAUCC | 2948 | GGAUACAG CUGAUGAGGNNNNNNNNCCGAA AGAGUUA | 7097 |
| 5410 | UCUACUGUA UCCUUUAG | 2949 | CUAAAGGA CUGAUGAGGNNNNNNNNCCGAA ACAGUAGA | 7098 |
| 5412 | UACUGUAUC CUUUAGAA | 2950 | UUCUAAAG CUGAUGAGGNNNNNNNNCCGAA AUACAGUA | 7099 |
| 5415 | UGUAUCCUU UAGAAUUU | 2951 | AAAUUCUA CUGAUGAGGNNNNNNNNCCGAA AGGAUACA | 7100 |
| 5416 | GUAUCCUUU AGAAUUUU | 2952 | AAAAUUCU CUGAUGAGGNNNNNNNNCCGAA AAGGAUAC | 7101 |
| 5417 | UAUCCUUUA GAAUUUUA | 2953 | UAAAAUUC CUGAUGAGGNNNNNNNNCCGAA AAAGGAUA | 7102 |
| 5422 | UUUAGAAUU UUAACCUA | 2954 | UAGGUUAA CUGAUGAGGNNNNNNNNCCGAA AUUCUAAA | 7103 |
| 5423 | UUAGAAUUU UAACCUAU | 2955 | AUAGGUUA CUGAUGAGGNNNNNNNNCCGAA AAUUCUAA | 7104 |
| 5424 | UAGAAUUUU AACCUAUA | 2956 | UAUAGGUU CUGAUGAGGNNNNNNNNCCGAA AAAUUCUA | 7105 |
| 5425 | AGAAUUUUA ACCUAUAA | 2957 | UUAUAGGU CUGAUGAGGcsCCGUUAGGCCGAA AAAAUUCU | 7106 |
| 5430 | UUUAACCUA UAAAACUA | 2958 | UAGUUUUA CUGAUGAGGNNNNNNNNCCGAA AGGUUAAA | 7107 |
| 5432 | UAACCUAUA AAACUAUG | 2959 | CAUAGUUU CUGAUGAGGNNNNNNNNCCGAA AUAGGUUA | 7108 |
| 5438 | AUAAACUA UGUCUACU | 2960 | AGUAGACA CUGAUGAGGNNNNNNNNCCGAA AGUUUUAU | 7109 |
| 5442 | AACUAUGUC UACUGGUU | 2961 | AACCAGUA CUGAUGAGGNNNNNNNNCCGAA ACAUAGUU | 7110 |
| 5444 | CUAUGUCUA CUGGUUUC | 2962 | GAAACCAG CUGAUGAGGNNNNNNNNCCGAA AGACAUAG | 7111 |
| 5450 | CUACUGGUU UCUGCCUG | 2963 | CAGGCAGA CUGAUGAGGNNNNNNNNCCGAA ACCAGUAG | 7112 |
| 5451 | UACUGGUUU CUGCCUGU | 2964 | ACAGGCAG CUGAUGAGGNNNNNNNNCCGAA AACCAGUA | 7113 |
| 5452 | ACUGGUUUC UGCCUGUG | 2965 | CACAGGCA CUGAUGAGGNNNNNNNNCCGAA AAACCAGU | 7114 |

Where "X" represents stem II region of a HH ribozyme (Hertel et al., 1992 Nucleic Acids Res. 20 3252). The length of stem II may be ≥ 2 base-pairs.
Underlined region can be any X sequence or linker, as described herein.

TABLE VII

Mouse flt-1 VEGF Receptor-Hairpin Ribozyme and Substrate Sequence 5

| Pos | Substrate | Seq ID No | HP Ribozyme | Seq ID No |
|---|---|---|---|---|
| 74 | GGGCCCA GAC UGUGUCCC | 2966 | GGGACACA AGAA GGGCCC ACCAGAGAAACACACGUUGUGGUACAUUACCUGGUA | 7115 |
| 88 | UCCCGCA GCC GGGAUAAC | 2967 | GUUAUCCC AGAA GCGGGA ACCAGAGAAACACACGUUGUGGUACAUUACCUGGUA | 7116 |
| 105 | CCUGGCU GAC CCGAUUCC | 2968 | GGAAUCGG AGAA AGCCAGG ACCAGAGAAACACACGUUGUGGUACAUUACCUGGUA | 7117 |
| 110 | CUGACCC GAU UCCGCGGA | 2969 | UCCGCGGA AGAA GGUCAG ACCAGAGAAACACACGUUGUGGUACAUUACCUGGUA | 7118 |
| 125 | GGACACC GCU GACAGCCG | 2970 | CGGCUGUC AGAA GUGUCC ACCAGAGAAACACACGUUGUGGUACAUUACCUGGUA | 7119 |
| 132 | GCUGACA GCC GCGGCUGG | 2971 | CCAGCCGC AGAA GUCAGC ACCAGAGAAACACACGUUGUGGUACAUUACCUGGUA | 7120 |
| 138 | AGCCGCG GCU GGAGCCAG | 2972 | CUGGCUCC AGAA GCGGCU ACCAGAGAAACACACGUUGUGGUACAUUACCUGGUA | 7121 |
| 175 | CUCCCCG GUC UUGCGCUG | 2973 | CAGCGCAA AGAA GGGGAG ACCAGAGAAACACACGUUGUGGUACAUUACCUGGUA | 7122 |
| 199 | CCAUACC GCC UCUGUGAC | 2974 | GUCACAGA AGAA GGUAUGG ACCAGAGAAACACACGUUGUGGUACAUUACCUGGUA | 7123 |
| 309 | GCUAGCU GUC GCUCUGUG | 2975 | CACAGAGC AGAA GCUAGC ACCAGAGAAACACACGUUGUGGUACAUUACCUGGUA | 7124 |
| 342 | CCGAGCC GCC UCUGUGGG | 2976 | CCCACAGA AGAA GCUCGG ACCAGAGAAACACACGUUGUGGUACAUUACCUGGUA | 7125 |
| 434 | CCCUUCA GAU UACUUGCA | 2977 | UGCAAGUA AGAA GAAGGG ACCAGAGAAACACACGUUGUGGUACAUUACCUGGUA | 7126 |
| 630 | CUCCACU GUU UAUGUCUA | 2978 | UAGACAUA AGAA GUGGAG ACCAGAGAAACACACGUUGUGGUACAUUACCUGGUA | 7127 |
| 655 | GAUUACA GAU CACCAUUC | 2979 | GAAUGGUG AGAA GUAAUC ACCAGAGAAACACACGUUGUGGUACAUUACCUGGUA | 7128 |
| 739 | AUCCCCU GCC GAGGGUCG | 2980 | CGACCCUC AGAA GGGGAU ACCAGAGAAACACACGUUGUGGUACAUUACCUGGUA | 7129 |
| 807 | UGUUCCG GAU GGAAACAG | 2981 | CUGUUUCC AGAA GGAACA ACCAGAGAAACACACGUUGUGGUACAUUACCUGGUA | 7130 |
| 920 | CCUAUCA GUC UAUCAUGU | 2982 | ACAUGAUA AGAA GAUAGG ACCAGAGAAACACACGUUGUGGUACAUUACCUGGUA | 7131 |
| 1002 | GCUAUCU GCC GGAGAAAA | 2983 | UUUUCUCC AGAA GAUAGC ACCAGAGAAACACACGUUGUGGUACAUUACCUGGUA | 7132 |
| 1229 | GUGGACG GAU GAUCAAGA | 2984 | UCUUGAUC AGAA GUCCAC ACCAGAGAAACACACGUUGUGGUACAUUACCUGGUA | 7133 |
| 1365 | UUACCCA GCU CCUGAUAU | 2985 | AUAUCAGG AGAA GGGUAA ACCAGAGAAACACACGUUGUGGUACAUUACCUGGUA | 7134 |

TABLE VII-continued

Mouse flt-1 VEGF Receptor-Hairpin Ribozyme and Substrate Sequence 5

| Pos | Substrate | Seq ID No | HP Ribozyme | Seq ID No |
|---|---|---|---|---|
| 1556 | CACCCCA GAU CGGUGAGA | 2986 | UCUCACCG AGAA GGGGUG ACCAGAGAAACACACGUUGUGGUACAUUACCUGGUA | 7135 |
| 1629 | AUGCACA GUC UACGCCAA | 2987 | UUGGCGUA AGAA GUGCAU ACCAGAGAAACACACGUUGUGGUACAUUACCUGGUA | 7136 |
| 1687 | GAAGCCU GCU CCUACAGA | 2988 | UCUGUAGG AGAA GGCUUC ACCAGAGAAACACACGUUGUGGUACAUUACCUGGUA | 7137 |
| 1696 | UCCUACA GAC CCGGCCAA | 2989 | UUGGCCGG AGAA GUAGGA ACCAGAGAAACACACGUUGUGGUACAUUACCUGGUA | 7138 |
| 1796 | AUGCCCU GAU UGAAGGAA | 2990 | UUCCUUCA AGAA GGGCAU ACCAGAGAAACACACGUUGUGGUACAUUACCUGGUA | 7139 |
| 1950 | GCAACCU GCU GCCCAGCC | 2991 | GGCUGGGC AGAA GGUUGC ACCAGAGAAACACACGUUGUGGUACAUUACCUGGUA | 7140 |
| 1953 | ACCUGCU GCC CAGCCAAC | 2992 | GUUGGCUG AGAA GCAGGU ACCAGAGAAACACACGUUGUGGUACAUUACCUGGUA | 7141 |
| 1985 | UGUCCCU GUU GUGCACUG | 2993 | CAGUGCAC AGAA GGGACA ACCAGAGAAACACACGUUGUGGUACAUUACCUGGUA | 7142 |
| 2055 | AACAUCG GUC CACAUGGG | 2994 | CCCAUGUG AGAA GAUGUU ACCAGAGAAACACACGUUGUGGUACAUUACCUGGUA | 7143 |
| 2082 | CACACCA GUU UGCAAGAA | 2995 | UUCUUGCA AGAA GGUGUG ACCAGAGAAACACACGUUGUGGUACAUUACCUGGUA | 6343 |
| 2208 | UUGCUCU GCU CAAGAUAA | 2996 | UUAUCUUG AGAA GAGCAA ACCAGAGAAACACACGUUGUGGUACAUUACCUGGUA | 7144 |
| 2252 | UCAAACA GCU CAUCAUCC | 2997 | GGAUGAUG AGAA GUUUGA ACCAGAGAAACACACGUUGUGGUACAUUACCUGGUA | 7145 |
| 2444 | GGAACCU GAC UAUCCGCA | 2998 | UGCGGAUA AGAA GGUUCC ACCAGAGAAACACACGUUGUGGUACAUUACCUGGUA | 7146 |
| 2639 | UCCUACG GAC CGUUAAGC | 2999 | GCUUAACG AGAA GUAGGA ACCAGAGAAACACACGUUGUGGUACAUUACCUGGUA | 7147 |
| 2703 | GGAUCCA GCU GAAUUGCC | 3000 | GGCAAUUC AGAA GGAUCC ACCAGAGAAACACACGUUGUGGUACAUUACCUGGUA | 7148 |
| 2777 | GGGACCG GCU GAAACUAG | 3001 | CUAGUUUC AGAA GGUCCC ACCAGAGAAACACACGUUGUGGUACAUUACCUGGUA | 7149 |
| 2832 | UGAGGCA GAC GCUUUGG | 3002 | CCAAAGC AGAA GCCUCA ACCAGAGAAACACACGUUGUGGUACAUUACCUGGUA | 7150 |
| 3199 | UCUGCCA GCU CAGGCUUU | 3003 | AAAGCCUG AGAA GGCAGA ACCAGAGAAACACACGUUGUGGUACAUUACCUGGUA | 7151 |
| 3278 | ACUUCCU GAC CUUGGAGC | 2199 | GCUCCAAG AGAA GGAAGU ACCAGAGAAACACACGUUGUGGUACAUUACCUGGUA | 6355 |
| 3304 | UGUUACA GCU UCCAAGUG | 2200 | CACUUGGA AGAA GUAACA ACCAGAGAAACACACGUUGUGGUACAUUACCUGGUA | 6356 |
| 3421 | GACUUCG GCU UGGCCCGG | 3004 | CCGGGCCA AGAA GAAGUC ACCAGAGAAACACACGUUGUGGUACAUUACCUGGUA | 7152 |
| 3450 | AGACCCG GAU UAUGUCAG | 3005 | CUGACAUA AGAA GGGUCU ACCAGAGAAACACACGUUGUGGUACAUUACCUGGUA | 7153 |
| 3475 | GAUGCCU GAC UCCCUUUG | 3006 | CAAAGGGA AGAA GGCAUC ACCAGAGAAACACACGUUGUGGUACAUUACCUGGUA | 7154 |
| 3663 | GGCUCCU GAC UACACUG | 3007 | GUAGUGUA AGAA GGAGCC ACCAGAGAAACACACGUUGUGGUACAUUACCUGGUA | 7155 |
| 3689 | UGUACCA GAC CAUGCUGG | 2203 | CCAGCAUG AGAA GGUACA ACCAGAGAAACACACGUUGUGGUACAUUACCUGGUA | 6359 |
| 3703 | CUGGACU GCU GGCAUGAG | 3008 | CUCAUGCC AGAA GUCCAG ACCAGAGAAACACACGUUGUGGUACAUUACCUGGUA | 7156 |
| 3860 | UCUCCCU GCC UACCUCAC | 3009 | GUGAGGUA AGAA GGGAGA ACCAGAGAAACACACGUUGUGGUACAUUACCUGGUA | 7157 |
| 3873 | CUCACCU GUU UCCUGUAU | 2206 | AUACAGGA AGAA GGUGAG ACCAGAGAAACACACGUUGUGGUACAUUACCUGGUA | 6362 |
| 4038 | GAUCCCA GAU GACAGCCA | 3010 | UGGCUGUC AGAA GGGAUC ACCAGAGAAACACACGUUGUGGUACAUUACCUGGUA | 7158 |
| 4181 | CCAACCA GAC CAGUGGCU | 3011 | AGCCACUG AGAA GGUUGG ACCAGAGAAACACACGUUGUGGUACAUUACCUGGUA | 7159 |
| 4196 | GCUACCA GUC UGGGUAUC | 3012 | GAUACCCA AGAA GGUAGC ACCAGAGAAACACACGUUGUGGUACAUUACCUGGUA | 7160 |
| 4212 | UCACUCA GAC GACACAGA | 3013 | UCUGUGUC AGAA GAGUGA ACCAGAGAAACACACGUUGUGGUACAUUACCUGGUA | 6367 |
| 4278 | UGCUGCA GUU CACGCUGA | 3014 | UCAGCGUG AGAA GCAGCA ACCAGAGAAACACACGUUGUGGUACAUUACCUGGUA | 7161 |
| 4287 | UCACGCU GAC UCAGGGAC | 3015 | GUCCCUGA AGAA GCGUGA ACCAGAGAAACACACGUUGUGGUACAUUACCUGGUdUA | 7162 |
| 4307 | CACUGCA GCU CACCUCCU | 3016 | AGGAGGUG AGAA GCAGUG ACCAGAGAAACACACGUUGUGGUACAUUACCUGGUA | 7163 |
| 4318 | ACCUCCU GCU UAAAUGGA | 3017 | UCCAUUUA AGAA GGAGGU ACCAGAGAAACACACGUUGUGGUACAUUACCUGGUA | 7164 |
| 4338 | UGGUCCU GUC CCGGCUCC | 3018 | GGAGCCGG AGAA GGACCA ACCAGAGAAACACACGUUGUGGUACAUUACCUGGUA | 7165 |
| 4344 | UGUCCCG GCU CCGCCCCC | 3019 | GGGGGCGG AGAA GGGACA ACCAGAGAAACACACGUUGUGGUACAUUACCUGGUA | 7166 |
| 4349 | CGGCUCC GCC CCCAACUC | 3020 | GAGUUGGG AGAA GAGCCG ACCAGAGAAACACACGUUGUGGUACAUUACCUGGUA | 7167 |
| 4383 | AGGUGCU GCU UAGAUUUU | 3021 | AAAAUCUA AGAA GCACCU ACCAGAGAAACACACGUUGUGGUACAUUACCUGGUA | 7168 |
| 4462 | GACCUCA GAC UGCAAGGA | 3022 | UCCUUGCA AGAA GAGGUC ACCAGAGAAACACACGUUGUGGUACAUUACCUGGUA | 7169 |
| 4574 | GUGCCCU GCU GUGGUCUC | 3023 | GAGACCAC AGAA GGGCAC ACCAGAGAAACACACGUUGUGGUACAUUACCUGGUA | 7170 |
| 4626 | GGACUCU GUC CUCCAAGA | 3024 | UCUUGGAG AGAA GAGUCC ACCAGAGAAACACACGUUGUGGUACAUUACCUGGUA | 7171 |
| 4723 | CGAGUCU GUC UACCUUGG | 3025 | CCAAGGUA AGAA GACUCG ACCAGAGAAACACACGUUGUGGUACAUUACCUGGUA | 7172 |
| 4823 | GAGAGCG GUU GGAGCCUG | 3026 | CAGGCUCC AGAA GCUCUC ACCAGAGAAACACACGUUGUGGUACAUUACCUGGUA | 7173 |
| 4836 | GCCUGCA GAU GCAUUGUG | 3027 | CACAAUGC AGAA GCAGGC ACCAGAGAAACACACGUUGUGGUACAUUACCUGGUA | 7174 |
| 4896 | AAAGGCG GCC GGCAGGGU | 3028 | ACCCUGCC AGAA GCCUUU ACCAGAGAAACACACGUUGUGGUACAUUACCUGGUA | 7175 |
| 4938 | CUUCACA GUC GGGUUACA | 3029 | UGUAACCC AGAA GUGAAG ACCAGAGAAACACACGUUGUGGUACAUUACCUGGUA | 7176 |
| 4996 | CCUUCCG GAC UCUUACGU | 3030 | ACGUAAGA AGAA GGAAGG ACCAGAGAAACACACGUUGUGGUACAUUACCUGGUA | 7177 |
| 5042 | UGAUGCA GAC UGCUCCUU | 3031 | AAGGAGCA AGAA GCAUCA ACCAGAGAAACACACGUUGUGGUACAUUACCUGGUA | 7178 |
| 5118 | GGCUCCU GAC GGGGCCGA | 3032 | UCGGCCCC AGAA GGAGCC ACCAGAGAAACACACGUUGUGGUACAUUACCUGGUA | 7179 |
| 5165 | GGUUUCU GCU GGGUGGAG | 3033 | CUCCACCC AGAA GAAACC ACCAGAGAAACACACGUUGUGGUACAUUACCUGGUA | 7180 |
| 5310 | GCUUCCU GAU GGCAGAAA | 3034 | UUUCUGCC AGAA GGAAGC ACCAGAGAAACACACGUUGUGGUACAUUACCUGGUA | 7181 |
| 5363 | CUAGCCA GAU UUCGAAAU | 3035 | AUUUCGAA AGAA GGCUAG ACCAGAGAAACACACGUUGUGGUACAUUACCUGGUA | 7182 |
| 5453 | GGUUUCU GCC UGUGUGCU | 3036 | AGCACACA AGAA GAAACC ACCAGAGAAACACACGUUGUGGUACAUUACCUGGUA | 7183 |

TABLE VIII

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 17 | GGCCGCGUC UUGCUCAC | 3037 | GUGAGCAA CUGAUGAGNNNNNNNNCCGAA ACGCGGCC | 7184 |
| 19 | CCGCGUCUU GCUCACCA | 3038 | UGGUGAGC CUGAUGAGNNNNNNNNCCGAA AGACGCGG | 7185 |
| 23 | GUCUUGCUC ACCAUGGU | 3039 | ACCAUGGU CUGAUGAGNNNNNNNNCCGAA AGCAAGAC | 7186 |
| 32 | ACCAUGGUC AGCUGCUG | 3040 | CAGCAGCU CUGAUGAGNNNNNNNNCCGAA ACCAUGGU | 7187 |
| 53 | ACCGCGGUC UUGCCUUA | 3041 | UAAGGCAA CUGAUGAGNNNNNNNNCCGAA ACCGCGGU | 7188 |
| 55 | CGCGUCUUU GCCUUACG | 3042 | CGUAAGGC CUGAUGAGNNNNNNNNCCGAA AGACCGCG | 7189 |
| 60 | UCUUGCCUU ACGCGCUG | 3043 | CAGCGCGU CUGAUGAGNNNNNNNNCCGAA AGGCAAGA | 7190 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 61 | CUUGCCUUA CGCGCUGC | 3044 | GCAGCGCG CUGAUGAGGNNNNNNNNNCCGAA AAGGCAAG | 7191 |
| 71 | GCGCUGCUC GGGUGUCU | 3045 | AGACACCC CUGAUGAGGNNNNNNNNNCCGAA AGCAGCGC | 7192 |
| 78 | UCGGGUGUC UGCUUCUC | 3046 | GAGAAGCA CUGAUGAGGNNNNNNNNNCCGAA ACACCCGA | 7193 |
| 83 | UGUCUGCUU CUCACAGG | 25 | ACUGUGAG CUGAUGAGGNNNNNNNNNCCGAA AGCAGACA | 4181 |
| 84 | GUCUGCUUC UCACAGGA | 26 | UCCUGUGA CUGAUGAGGNNNNNNNNNCCGAA AAGCAGAC | 4182 |
| 86 | CUGCUUCUC ACAGGAUA | 3047 | UAUCCUGU CUGAUGAGGNNNNNNNNNCCGAA AGAAGCAG | 7194 |
| 94 | CACAGGAUA UGGCUCAG | 3048 | CUGAGCCA CUGAUGAGGNNNNNNNNNCCGAA AUCCUGUG | 7195 |
| 100 | AUAUGGCUC AGGGUCGA | 3049 | UCGACCCU CUGAUGAGGNNNNNNNNNCCGAA AGCCAUAU | 7196 |
| 106 | CUCAGGGUC GAAGUUAA | 3050 | UUAACUUC CUGAUGAGGNNNNNNNNNCCGAA ACCCUGAG | 7197 |
| 112 | GUCGAAGUU AAAAGUGC | 3051 | GCAGUUUU CUGAUGAGGNNNNNNNNNCCGAA ACUUCGAC | 7198 |
| 113 | UCGAAGUUA AAAGUGCC | 3052 | GGCACUUU CUGAUGAGGNNNNNNNNNCCGAA AACUUCGA | 7199 |
| 132 | AACUGAGUU AUAAAGGC | 37 | GCCUUUUA CUGAUGAGGNNNNNNNNNCCGAA ACUCAGUU | 4193 |
| 133 | ACUGAGUUU AAAAGGCA | 38 | UGCCUUUU CUGAUGAGGNNNNNNNNNCCGAA AACUCAGU | 4194 |
| 134 | CUGAGUUUC AAAGGCAC | 39 | GUGCCUUU CUGAUGAGGNNNNNNNNNCCGAA AAACUCAG | 4195 |
| 152 | CAGCAUGUC AUGCAAGC | 3053 | GCUUGCAU CUGAUGAGGNNNNNNNNNCCGAA ACAUGCUG | 7200 |
| 171 | GCCAGACUC UCUUUCUC | 3054 | GAGAAAGA CUGAUGAGGNNNNNNNNNCCGAA AGUCUGGC | 7201 |
| 173 | CAGACUCUC UUUCUCAA | 3055 | UUGAGAAA CUGAUGAGGNNNNNNNNNCCGAA AGAGUCUG | 7202 |
| 175 | GACUCUCUU UCUCAAGU | 3056 | ACUUGAGA CUGAUGAGGNNNNNNNNNCCGAA AGAGAGUC | 7203 |
| 176 | ACUCUCUUU CUCAAGUG | 3057 | CACUUGAG CUGAUGAGGNNNNNNNNNCCGAA AAGAGAGU | 7204 |
| 177 | CUCUCUUUC UCAAGUGC | 3058 | GCACUUGA CUGAUGAGGNNNNNNNNNCCGAA AAAGAGAG | 7205 |
| 179 | CUCUUUCUC AAGUGCAG | 3059 | CUGCACUU CUGAUGAGGNNNNNNNNNCCGAA AGAAAGAG | 7206 |
| 205 | AGCCCACUC AUGGUCUC | 3060 | GAGACCAU CUGAUGAGGNNNNNNNNNCCGAA AGUGGGCU | 7207 |
| 211 | CUCAUGGUC UCUGCCCA | 3061 | UGGGCAGA CUGAUGAGGNNNNNNNNNCCGAA ACCAUGAG | 7208 |
| 213 | CAUGGUCUC UGCCCACG | 3062 | CGUGGGCA CUGAUGAGGNNNNNNNNNCCGAA AGACCAUG | 7209 |
| 254 | CUGAGCAUC ACUCCCCC | 3063 | GGGGGAGU CUGAUGAGGNNNNNNNNNCCGAA AUGCUCAG | 7210 |
| 258 | GCAUCACUC CCCCAUCG | 3064 | CGAUGGGG CUGAUGAGGNNNNNNNNNCCGAA AGUGAUGC | 7211 |
| 265 | UCCCCCAUC GGCCUGUG | 3065 | CACAGGCC CUGAUGAGGNNNNNNNNNCCGAA AUGGGGGA | 7212 |
| 282 | GGAGGGAUA ACAGGCAA | 3066 | UUGCCUGU CUGAUGAGGNNNNNNNNNCCGAA AUCCCUCC | 7213 |
| 292 | CAGGCAAUU CUGCAGCA | 3067 | UGCUGCAG CUGAUGAGGNNNNNNNNNCCGAA AUUGCCUG | 7214 |
| 293 | AGGCAAUUC UGCAGCAC | 3068 | GUGCUGCA CUGAUGAGGNNNNNNNNNCCGAA AAGGUCCU | 7215 |
| 304 | CAGCACCUU GACCUUGG | 3069 | CCAAGGUC CUGAUGAGGNNNNNNNNNCCGAA AGGUGCUG | 7216 |
| 310 | CUUGACCUU GGACACGG | 3070 | GGCUCUGG CUGAUGAGGNNNNNNNNNCCGAA AGGUCAAG | 7217 |
| 341 | ACGGGCCUA UACACCUG | 3071 | CAGGUGUA CUGAUGAGGNNNNNNNNNCCGAA AGGCCCGU | 7218 |
| 343 | GGGCUCUA CACCUGUA | 3072 | UACAGGUG CUGAUGAGGNNNNNNNNNCCGAA AGAGGCCC | 7219 |
| 351 | ACACCUGA GAUACCUC | 3073 | GAGGUAUC CUGAUGAGGNNNNNNNNNCCGAA ACAGGUGU | 7220 |
| 355 | CUGUAGAUA CCUCCCUA | 3074 | UAGGGAGG CUGAUGAGGNNNNNNNNNCCGAA AUCUACAG | 7221 |
| 359 | AGAUACCUC CCUACAUC | 3075 | GAUGUAGG CUGAUGAGGNNNNNNNNNCCGAA AGGUAUCU | 7222 |
| 363 | ACCUCCCUA CAUCUACU | 3076 | AGUAGAUG CUGAUGAGGNNNNNNNNNCCGAA AGGGAGGU | 7223 |
| 367 | CCCUACAUC UACUUCGA | 3077 | UCGAAGUA CUGAUGAGGNNNNNNNNNCCGAA AUGUAGGG | 7224 |
| 369 | CUACAUCUA CUUCGAAG | 3078 | CUUCGAAG CUGAUGAGGNNNNNNNNNCCGAA AGAUGUAG | 7225 |
| 372 | CAUCUACUU CGAAGAAA | 3079 | UUUCUUCG CUGAUGAGGNNNNNNNNNCCGAA AGUAGAUG | 7226 |
| 373 | AUCUACUUC GAAGAAAA | 3080 | UUUUCUUC CUGAUGAGGNNNNNNNNNCCGAA AAGUAGAU | 7227 |
| 394 | AGCGGAAUC UUCAAUCU | 3081 | AGAUUGAA CUGAUGAGGNNNNNNNNNCCGAA AUUCCGCU | 7228 |
| 396 | CGGAAUCUU CAAUCUAC | 3082 | GUAGAUUG CUGAUGAGGNNNNNNNNNCCGAA AGAUUCCG | 7229 |
| 397 | GGAAUCUUC AAUCUACA | 3083 | UGUAGAUU CUGAUGAGGNNNNNNNNNCCGAA AAGAUUCC | 7230 |
| 401 | UCUUCAAUC UACAUAUU | 3084 | AAUAUGUA CUGAUGAGGNNNNNNNNNCCGAA AUUGAAGA | 7231 |
| 403 | UUCAAUCUA CAUAUUUG | 3085 | CAAAUAUG CUGAUGAGGNNNNNNNNNCCGAA AGAUUGAA | 7232 |
| 407 | AUCUACAUA UUUGUUAG | 3086 | CUAACAAA CUGAUGAGGNNNNNNNNNCCGAA AUGUAGAU | 7233 |
| 409 | CUACAUAUU UGUUAGUG | 3087 | CACUAACA CUGAUGAGGNNNNNNNNNCCGAA AUAUGUAG | 7234 |
| 410 | UACAUAUUU GUUAGUGA | 3088 | UCACUAAC CUGAUGAGGNNNNNNNNNCCGAA AAUAUGUA | 7235 |
| 413 | AUAUUUGUU AGUGAUGC | 3089 | GCAUCACU CUGAUGAGGNNNNNNNNNCCGAA ACAAAUAU | 7236 |
| 414 | UAUUUGUUA GUGAUGCA | 3090 | UGCAUCAC CUGAUGAGGNNNNNNNNNCCGAA AACAAAUA | 7237 |
| 429 | CAGGGAGUC UUUCAUA | 3091 | UAUGCCCG CUGAUGAGGNNNNNNNNNCCGAA ACUCCCUG | 7238 |
| 432 | GGAGUCCUU UCAUAGAG | 3092 | CUCUAUGA CUGAUGAGGNNNNNNNNNCCGAA AGGACUCC | 7239 |
| 433 | GAGUCCUUU CAUAGAGA | 3093 | UCUCUAUG CUGAUGAGGNNNNNNNNNCCGAA AACCACUC | 7240 |
| 434 | AGUCCUUUC AUAGAGAU | 3094 | AUCUCUAU CUGAUGAGGNNNNNNNNNCCGAA AAAGGACU | 7241 |
| 437 | CCUUUCAUA GAGAUGCA | 3095 | UGCAUCUC CUGAUGAGGNNNNNNNNNCCGAA AUGAAAGG | 7242 |
| 455 | ACUGACAUA CCCAAACU | 3096 | AGUUUGGG CUGAUGAGGNNNNNNNNNCCGAA AUGUCAGU | 7243 |
| 464 | CCCAAACUU GUGCACAU | 3097 | AUGUGCAC CUGAUGAGGNNNNNNNNNCCGAA AGUUUGGG | 7244 |
| 491 | AGACAGCUC AUCAUCCC | 3098 | GGGAUGAU CUGAUGAGGNNNNNNNNNCCGAA AGCUGUCU | 7245 |
| 494 | CAGCUCAUC AUCCCCUG | 3099 | CAGGGGAU CUGAUGAGGNNNNNNNNNCCGAA AUGAGCUG | 7246 |
| 497 | CUCAUCAUC CCCUGCCG | 3100 | CGGCAGGG CUGAUGAGGNNNNNNNNNCCGAA AUGAUGAG | 7247 |
| 514 | GGUGACGUC ACCCAACG | 3101 | CGUUGGGU CUGAUGAGGNNNNNNNNNCCGAA ACGUCACC | 7248 |
| 524 | CCCAACGUU ACAGUCAC | 3102 | GUGACUGU CUGAUGAGGNNNNNNNNNCCGAA ACGUUGGG | 7249 |
| 530 | GUCACAGUC ACCCUAAA | 3103 | UUUAGGGU CUGAUGAGGNNNNNNNNNCCGAA ACUGUGAC | 7250 |
| 536 | GUCACCCUA AAAAAGUU | 3104 | AACUUUUU CUGAUGAGGNNNNNNNNNCCGAA AGGGUGAC | 7251 |
| 544 | AAAAAGUU UCCAUUUG | 3105 | CAAAUGGA CUGAUGAGGNNNNNNNNNCCGAA ACUUUUUU | 7252 |
| 545 | AAAAAGUUU CCAUUUGA | 3106 | UCAAAUGG CUGAUGAGGNNNNNNNNNCCGAA AACUUUUU | 7253 |
| 546 | AAAAGUUUC CAUUUGAU | 3107 | AUCAAAUG CUGAUGAGGNNNNNNNNNCCGAA AAACUUUU | 7254 |
| 550 | GUUUCCAUU UGAUACUC | 3108 | GAGUAUCA CUGAUGAGGNNNNNNNNNCCGAA AUGGAAAC | 7255 |
| 551 | UUUCCAUUU GAUACUCU | 3109 | AGAGUAUC CUGAUGAGGNNNNNNNNNCCGAA AAUGGAAA | 7256 |
| 555 | CAUUUGAUA CUCUUACC | 3110 | GGUAAGAG CUGAUGAGGNNNNNNNNNCCGAA AUCAAAUG | 7257 |
| 558 | UUGAUACUC UUACCCCU | 3111 | AGGGGUAA CUGAUGAGGNNNNNNNNNCCGAA AGUAUCAA | 7258 |

TABLE VIII-continued

Mouse *flt*-1 VEGF Receptor-Hammerhead Ribozyme and Substrate Sequence

| Pos | Substrate | Seq ID No | HH Ribozyme Sequence | Seq ID No |
|---|---|---|---|---|
| 560 | GAUACUCUU ACCCCUGA | 3112 | UCAGGGGU CUGAUGAGGNNNNNNNNCCGAA AGAGUAUC | 7259 |
| 561 | AUACUCUUA CCCCUGAU | 3113 | AUCAGGGG CUGAUGAGGNNNNNNNNCCGAA AAGAGUAU | 7260 |
| 581 | CAAAGAAUA ACAUGGGA | 3114 | UCCCAUGU CUGAUGAGGNNNNNNNNCCGAA AUUCUUUG | 7261 |
| 594 | GGGACAGUA GGAGAGGC | 3115 | GCCUCUCC CUGAUGAGGNNNNNNNNCCGAA ACUGUCCC | 7262 |
| 604 | GAGAGGCUU UAUAAUAG | 3116 | CUAUUAUA CUGAUGAGGNNNNNNNNCCGAA AGCCUCUC | 7263 |
| 605 | AGAGGCUUU AUAAUAGC | 3117 | GCUAUUAU CUGAUGAGGNNNNNNNNCCGAA AAGCCUCU | 7264 |
| 606 | GAGGCUUUA UAAUAGCA | 3118 | UGCUAUUA CUGAUGAGGNNNNNNNNCCGAA AAAGCCUC | 7265 |
| 608 | GGCUUUAUA AUAGCAAA | 3119 | UUUGCUAU CUGAUGAGGNNNNNNNNCCGAA AUAAAGCC | 7266 |
| 611 | UUUAUAAUA GCAAAUGC | 3120 | GCAUUUGC CUGAUGAGGNNNNNNNNCCGAA AUUAUAAA | 7267 |
| 625 | UGCAACGUA CAAAGAGA | 3121 | UCUCUUUG CUGAUGAGGNNNNNNNNCCGAA ACGUUGCA | 7268 |
| 635 | AAAGAGAUA GGACUGCU | 3122 | AGCAGUCC CUGAUGAGGNNNNNNNNCCGAA AUCUCUUU | 7269 |
| 662 | GCCACCGUC AACGGGCA | 3123 | UGCCCGUU CUGAUGAGGNNNNNNNNCCGAA ACGGUGGC | 7270 |
| 676 | GCACCUGUA CCAGACAA | 3124 | UUGUCUGG CUGAUGAGGNNNNNNNNCCGAA ACAGGUGC | 7271 |
| 688 | GACAAACUA UCUGACCC | 3125 | GGGUCAGA CUGAUGAGGNNNNNNNNCCGAA AGUUUGUC | 7272 |
| 690 | CAAACUAUC UGACCCAU | 3126 | AUGGGUCA CUGAUGAGGNNNNNNNNCCGAA AUAGUUUG | 7273 |
| 699 | UGACCCAUC GGCAGACC | 3127 | GGUCUGCC CUGAUGAGGNNNNNNNNCCGAA AUGGGUCA | 7274 |
| 711 | AGACCAAUA CAAUCCUA | 3128 | UAGGAUUG CUGAUGAGGNNNNNNNNCCGAA AUUGGUCU | 7275 |
| 716 | AAUACAAUC CUAGAUGU | 3129 | ACAUCUAG CUGAUGAGGNNNNNNNNCCGAA AUUGUAUU | 7276 |
| 719 | ACAAUCCUA GAUGUCCA | 3130 | UGGACAUC CUGAUGAGGNNNNNNNNCCGAA AGGAUUGU | 7277 |
| 725 | CUAGAUGUC CAAAUACG | 3131 | CGUAUUUG CUGAUGAGGNNNNNNNNCCGAA ACAUCUAG | 7278 |
| 731 | GUCCAAAUA CGCCCGCC | 3132 | GGCGGGCG CUGAUGAGGNNNNNNNNCCGAA AUUUGGAC | 7279 |
| 758 | AGACUGCUC CACGGGCA | 3133 | UGCCCGUG CUGAUGAGGNNNNNNNNCCGAA AGCAGUCU | 7280 |
| 771 | GGCAGACUC UUGUCCUC | 3134 | GAGGACAA CUGAUGAGGNNNNNNNNCCGAA AGUCUGCC | 7281 |
| 773 | CAGACUCUU GUCCUCAA | 3135 | UUCAGGAC CUGAUGAGGNNNNNNNNCCGAA AGAGUCUG | 7282 |
| 776 | ACUCUUGUC CUCAACUG | 3136 | CAGUUGAG CUGAUGAGGNNNNNNNNCCGAA ACAAGAGU | 7283 |
| 779 | CUUGCCUC AACUGCAC | 3137 | GUGCAGUU CUGAUGAGGNNNNNNNNCCGAA AGGACAAG | 7284 |
| 803 | ACGGAGCUC AAUACGAG | 3138 | CUCGUAUU CUGAUGAGGNNNNNNNNCCGAA AGCUCCGU | 7285 |
| 807 | AGCUCAAUA CGAGGGUG | 3139 | CACCCUCG CUGAUGAGGNNNNNNNNCCGAA AUUGAGCU | 7286 |
| 831 | GCUGGAAUU ACCCUGGU | 3140 | ACCAGGGU CUGAUGAGGNNNNNNNNCCGAA AUUCCAGC | 7287 |
| 832 | CUGGAAUUA CCCUGGUA | 3141 | UACCAGGG CUGAUGAGGNNNNNNNNCCGAA AAUUCCAG | 7288 |
| 840 | ACCCUGGUA AAGCAACU | 3142 | AGUUGCUU CUGAUGAGGNNNNNNNNCCGAA ACCAGGGU | 7289 |
| 849 | AAGCAACUA AGAGAGCA | 3143 | UGCUCUCU CUGAUGAGGNNNNNNNNCCGAA AGUUGCUU | 7290 |
| 859 | GAGAGCAUC UAUAAGGC | 3144 | GCCUUAUA CUGAUGAGGNNNNNNNNCCGAA AUGCUCUC | 7291 |
| 861 | GAGCAUCUA UAAGGCAG | 3145 | CUGCCUUA CUGAUGAGGNNNNNNNNCCGAA AGAUGCUC | 7292 |
| 863 | GCAUCUAUA AGGCAGCG | 3146 | CGCUGCCU CUGAUGAGGNNNNNNNNCCGAA AUAGAUGC | 7293 |
| 875 | CAGCGGAUU GACCGGAG | 3147 | CUCCGGUC CUGAUGAGGNNNNNNNNCCGAA AUCCGCUG | 7294 |
| 888 | GGAGCCAUU CCCACAAC | 3148 | GUUGUGGG CUGAUGAGGNNNNNNNNCCGAA AUGGCUCC | 7295 |
| 889 | GAGCCAUUC CCACAACA | 3149 | UGUUGUGG CUGAUGAGGNNNNNNNNCCGAA AAUGGCUC | 7296 |
| 904 | CAAUGUGUU CCACAGUG | 3150 | CACUGUGG CUGAUGAGGNNNNNNNNCCGAA ACACAUUG | 7297 |
| 905 | AAUGUGUUC CACAGUGU | 3151 | ACACUGUG CUGAUGAGGNNNNNNNNCCGAA AACACAUU | 7298 |
| 914 | CACAGUGUU CUUAAGAU | 3152 | AUCUUAAG CUGAUGAGGNNNNNNNNCCGAA ACACUGUG | 7299 |
| 915 | ACAGUGUUC UUAAGAUC | 3153 | GAUCUUAA CUGAUGAGGNNNNNNNNCCGAA AACACUGU | 7300 |
| 917 | AGUGUUCUU AAGAUCAA | 3154 | UUGAUCUU CUGAUGAGGNNNNNNNNCCGAA AGAACACU | 7301 |
| 918 | GUGUUCUUA AGAUCAAC | 3155 | GUUGAUCU CUGAUGAGGNNNNNNNNCCGAA AAGAACAC | 7302 |
| 923 | CUUAAGAUC AACAAUGU | 3156 | ACAUUGUU CUGAUGAGGNNNNNNNNCCGAA AUCUUAAG | 7303 |
| 953 | AAGGGGCUC UACACCUG | 3157 | CAGGUGUA CUGAUGAGGNNNNNNNNCCGAA AGCCCCUU | 7304 |
| 955 | GGGGCUCUA CACCUGUC | 3158 | GACAGGUG CUGAUGAGGNNNNNNNNCCGAA AGAGCCCC | 7305 |
| 963 | ACACCUGUC GCGUGAAG | 3159 | CUUCACGC CUGAUGAGGNNNNNNNNCCGAA ACAGGUGU | 7306 |
| 979 | GAGUGGGUC CUCGUUCC | 3160 | GGAACGAG CUGAUGAGGNNNNNNNNCCGAA ACCCACUC | 7307 |
| 982 | UGGGUCCUC GUUCCAGU | 3161 | ACUGGAAC CUGAUGAGGNNNNNNNNCCGAA AGGACCCA | 7308 |
| 985 | GUCCUCGUU CCAGUCUU | 3162 | AAGACUGG CUGAUGAGGNNNNNNNNCCGAA ACGAGGAC | 7309 |
| 986 | UCCUCGUUC CAGUCUUU | 3163 | AAAGACUG CUGAUGAGGNNNNNNNNCCGAA AACGAGGA | 7310 |
| 991 | GUUCCAGUC UUUCAACA | 3164 | UGUUGAAA CUGAUGAGGNNNNNNNNCCGAA ACUGGAAC | 7311 |
| 993 | UCCAGUCUU UCAACACC | 3165 | GGUGUUGA CUGAUGAGGNNNNNNNNCCGAA AGACUGGA | 7312 |
| 994 | CCAGUCUUU CAACACCU | 3166 | AGGUGUUG CUGAUGAGGNNNNNNNNCCGAA AAGACUGG | 7313 |
| 995 | CAGUCUUUC AACACCUC | 3167 | GAGGUGUU CUGAUGAGGNNNNNNNNCCGAA AAAGACUG | 7314 |
| 1003 | CAACACCUC CGUGCAUG | 3168 | CAUGCACG CUGAUGAGGNNNNNNNNCCGAA AGGUGUUG | 7315 |
| 1015 | GCAUGUGUA UCAAAAAG | 3169 | CUUUUUGA CUGAUGAGGNNNNNNNNCCGAA ACACAUGC | 7316 |
| 1027 | AAAAGGAUU CAUCAGUG | 3170 | CACUGAUG CUGAUGAGGNNNNNNNNCCGAA AUCCUUUU | 7317 |
| 1028 | AAAGGAUUC AUCAGUGU | 3171 | ACACUGAU CUGAUGAGGNNNNNNNNCCGAA AAUCCUUU | 7318 |
| 1031 | GGAUUCAUC AGUGUGAA | 3172 | UUCACACU CUGAUGAGGNNNNNNNNCCGAA AUGAAUCC | 7319 |
| 1044 | UGAAACAUC GGAAGCAG | 3173 | CUGCUUCC CUGAUGAGGNNNNNNNNCCGAA AUGUUUCA | 7320 |
| 1084 | AAGACGGUC CUAUCGGC | 3174 | GCCGAUAG CUGAUGAGGNNNNNNNNCCGAA ACCGUCUU | 7321 |
| 1087 | ACGGUCCUA UCGGCUGU | 3175 | ACAGCCGA CUGAUGAGGNNNNNNNNCCGAA AGGACCGU | 7322 |
| 1089 | GGUCCUAUC GGCUGUCC | 3176 | GGACAGCC CUGAUGAGGNNNNNNNNCCGAA AUAGGACC | 7323 |
| 1096 | UCGGCUGUC CAUGAAAG | 3177 | CUUUCAUG CUGAUGAGGNNNNNNNNCCGAA ACAGCCGA | 7324 |
| 1114 | GAAGGCCUU CCCCUCCC | 3178 | GGGAGGGG CUGAUGAGGNNNNNNNNCCGAA AGGCCUUC | 7325 |
| 1115 | AAGGCCUUC CCCUCCCC | 3179 | GGGGAGGG CUGAUGAGGNNNNNNNNCCGAA AAGGCCUU | 7326 |
| 1120 | CUUCCCCUC CCCAGAAA | 3180 | UUUCUGGG CUGAUGAGGNNNNNNNNCCGAA AGGGGAAG | 7327 |
| 1130 | CCAGAAAUC GUAUGGUU | 3181 | AACCAUAC CUGAUGAGGNNNNNNNNCCGAA AUUUCUGG | 7328 |
| 1133 | GAAAUCGUA UGGUUAAA | 3182 | UUUAACCA CUGAUGAGGNNNNNNNNCCGAA ACGAUUUC | 7329 |
| 1138 | CGUAUGGUU AAAAGAUG | 3183 | CAUCUUUU CUGAUGAGGNNNNNNNNCCGAA ACCAUACG | 7330 |
| 1139 | GUAUGGUUA AAAGAUGG | 210 | CCAUCUUU CUGAUGAGGNNNNNNNNCCGAA AACCAUAC | 4366 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1150 | AGAUGGCUC GCCUGCAA | 3184 | UUGCAGGC CUGAUGAGGNNNNNNNNCCGAA AGCCAUCU | 7331 |
| 1162 | UGCAACAUU GAAGUCUG | 3185 | CAGACUUC CUGAUGAGGNNNNNNNNCCGAA AUGUUGCA | 7332 |
| 1168 | AUUGAAGUC UGCUCGCU | 3186 | AGCGAGCA CUGAUGAGGNNNNNNNNCCGAA ACUUCAAU | 7333 |
| 1173 | AGUCUGCUC GCUAUUUG | 3187 | CAAAUAGC CUGAUGAGGNNNNNNNNCCGAA AGCAGACU | 7334 |
| 1177 | UGCUCGCUA UUUGGUAC | 3188 | GUACCAAA CUGAUGAGGNNNNNNNNCCGAA AGCGAGCA | 7335 |
| 1179 | CUCGCUAUU UGGUACAU | 3189 | AUGUACCA CUGAUGAGGNNNNNNNNCCGAA AUAGCGAG | 7336 |
| 1180 | UCGCUAUUU GGUACAUG | 3190 | CAUGUACC CUGAUGAGGNNNNNNNNCCGAA AAUAGCGA | 7337 |
| 1184 | UAUUUGGUA CAUGGCUA | 3191 | UAGCCAUG CUGAUGAGGNNNNNNNNCCGAA ACCAAAUA | 7338 |
| 1192 | ACAUGGCUA CUCAUUAA | 3192 | UUAAUGAG CUGAUGAGGNNNNNNNNCCGAA AGCCAUGU | 7339 |
| 1195 | UGGCUACUC AUUAAUUA | 3193 | UAAUUAAU CUGAUGAGGNNNNNNNNCCGAA AGUAGCCA | 7340 |
| 1198 | CUACUCAUU AAUUAUCA | 3194 | UGAUAAUU CUGAUGAGGNNNNNNNNCCGAA AUGAGUAG | 7341 |
| 1199 | UACUCAUUA AUUAUCAA | 3195 | UUGAUAAU CUGAUGAGGNNNNNNNNCCGAA AAUGAGUA | 7342 |
| 1202 | UCAUUAAUU AUCAAAGA | 3196 | UCUUUGAU CUGAUGAGGNNNNNNNNCCGAA AUUAAUGA | 7343 |
| 1203 | CAUUAAUUA UCAAAGAU | 3197 | AUCUUUGA CUGAUGAGGNNNNNNNNCCGAA AAUUAAUG | 7344 |
| 1205 | UUAAUUAUC AAAGAUGU | 3198 | ACAUCUUU CUGAUGAGGNNNNNNNNCCGAA AUAAUUAA | 7345 |
| 1237 | AGGGGACUA UACGAUCU | 3199 | AGAUCGUA CUGAUGAGGNNNNNNNNCCGAA AGUCCCCU | 7346 |
| 1239 | GGGACUAUA CGAUCUUG | 3200 | CAAGAUCG CUGAUGAGGNNNNNNNNCCGAA AUAGUCCC | 7347 |
| 1244 | UAUACGAUC UUGCUGGG | 3201 | CCCAGCAA CUGAUGAGGNNNNNNNNCCGAA AUCGUAUA | 7348 |
| 1246 | UACGAUCUU GCUGGGCA | 3202 | UGCCCAGC CUGAUGAGGNNNNNNNNCCGAA AGAUCGUA | 7349 |
| 1256 | CUGGGCAUA AAGCAGUC | 3203 | GACUGCUU CUGAUGAGGNNNNNNNNCCGAA AUGCCCAG | 7350 |
| 1264 | AAAGCAGUC AAGGCUAU | 3204 | AUAGCCUU CUGAUGAGGNNNNNNNNCCGAA ACUGCUUU | 7351 |
| 1271 | UCAAGGCUA UUUAAAAA | 3205 | UUUUUAAA CUGAUGAGGNNNNNNNNCCGAA AGCCUUGA | 7352 |
| 1273 | AAGGCUAUU UAAAAACC | 3206 | GGUUUUUA CUGAUGAGGNNNNNNNNCCGAA AUAGCCUU | 7353 |
| 1274 | AGGCUAUUU AAAAACCU | 3207 | AGGUUUUU CUGAUGAGGNNNNNNNNCCGAA AAUAGCCU | 7354 |
| 1275 | GGCUAUUUA AAAACCUC | 3208 | GAGGUUUU CUGAUGAGGNNNNNNNNCCGAA AAAUAGCC | 7355 |
| 1283 | AAAAACCUC ACUGCCAC | 237 | GUGGCAGU CUGAUGAGGNNNNNNNNCCGAA AGGUUUUU | 4393 |
| 1293 | CUGCCACUC UCAUUGUA | 3209 | UACAAUGA CUGAUGAGGNNNNNNNNCCGAA AGUGGCAG | 7356 |
| 1295 | GCCACUCUC AUUGUAAA | 3210 | UUUACAAU CUGAUGAGGNNNNNNNNCCGAA AGAGUGGC | 7357 |
| 1298 | ACUCUCAUU GUAAACGA | 3211 | ACGUUUAC CUGAUGAGGNNNNNNNNCCGAA AUGAGAGU | 7358 |
| 1301 | CUCAUUGUA AACGUGAA | 3212 | UUCACGUU CUGAUGAGGNNNNNNNNCCGAA ACAAUGAG | 7359 |
| 1314 | UGAAACCUC AGAUCUAC | 3213 | GUAGAUCU CUGAUGAGGNNNNNNNNCCGAA AGGUUUCA | 7360 |
| 1319 | CCUCAGAUC UACGAAAA | 3214 | UUUUCGUA CUGAUGAGGNNNNNNNNCCGAA AUCUGAGG | 7361 |
| 1321 | UCAGAUCUA CGAAAAGU | 3215 | ACUUUUCG CUGAUGAGGNNNNNNNNCCGAA AGAUCUGA | 7362 |
| 1330 | CGAAAAGUC CGUCUCCU | 3216 | AGGACACG CUGAUGAGGNNNNNNNNCCGAA ACUUUUCG | 7363 |
| 1336 | GUCCGUGUC CUCGCUUC | 3217 | GAAGCGAG CUGAUGAGGNNNNNNNNCCGAA ACACGGAC | 7364 |
| 1339 | CGUGUCCUC GCUUCCAA | 3218 | UUGGAAGC CUGAUGAGGNNNNNNNNCCGAA AGGACACG | 7365 |
| 1343 | UCCUCGCUU CCAAGCCC | 3219 | GGGCUUGG CUGAUGAGGNNNNNNNNCCGAA AGCGACCA | 7366 |
| 1344 | CCUCGCUUC CAAGCCCA | 3220 | UGGGCUUG CUGAUGAGGNNNNNNNNCCGAA AAGCGAGG | 7367 |
| 1356 | GCCCACCUC UCUAUCCG | 3221 | CGGAUAGA CUGAUGAGGNNNNNNNNCCGAA AGGUGGGC | 7368 |
| 1358 | CCACCUCUC UAUCCGCU | 3222 | AGCGGAUA CUGAUGAGGNNNNNNNNCCGAA AGAGGUGG | 7369 |
| 1360 | ACCUCUCUA UCCGCUGG | 3223 | CCAGCGGA CUGAUGAGGNNNNNNNNCCGAA AGAGAGGU | 7370 |
| 1362 | CUCUCUAUC CGCUGGGC | 3224 | GCCCAGCG CUGAUGAGGNNNNNNNNCCGAA AUAGAGAG | 7371 |
| 1382 | AGACAAGUC CUCACUUG | 3225 | CAAGUGAG CUGAUGAGGNNNNNNNNCCGAA ACUUGUCU | 7372 |
| 1385 | CAAGUCCUC ACUUGCAC | 3226 | GUGCAAGU CUGAUGAGGNNNNNNNNCCGAA AGGACUUG | 7373 |
| 1389 | UCCUCACUU GCACCGUG | 3227 | CACGGUGC CUGAUGAGGNNNNNNNNCCGAA AGUGAGGA | 7374 |
| 1399 | CACCGUGUA UGGCAUCC | 3228 | GGAUGCCA CUGAUGAGGNNNNNNNNCCGAA AGAGGGUG | 7375 |
| 1406 | UAUGGCAUG CCUCGGCC | 3229 | GGCCGAGG CUGAUGAGGNNNNNNNNCCGAA AUGCCAUA | 7376 |
| 1410 | GCAUCCCUC GGCCAACA | 3230 | UGUUGGCC CUGAUGAGGNNNNNNNNCCGAA AGGGAUGC | 7377 |
| 1421 | CCAACAAUC ACGUGGCU | 3231 | AGCCACGU CUGAUGAGGNNNNNNNNCCGAA AUUCUUGG | 7378 |
| 1430 | ACGUGGCUC UGGCACCC | 3232 | GGGUGCCA CUGAUGAGGNNNNNNNNCCGAA AGCCACGU | 7379 |
| 1443 | ACCCCUGUC ACCACAAU | 3233 | AUUGUGGU CUGAUGAGGNNNNNNNNCCGAA ACAGGGGU | 7380 |
| 1452 | ACCACAAUC ACUCCAAA | 3234 | UUUGGAGU CUGAUGAGGNNNNNNNNCCGAA AUUGUGGU | 7381 |
| 1456 | CAAUCACUC CAAAGAAA | 3235 | UUUCUUUG CUGAUGAGGNNNNNNNNCCGAA AGUGAUUG | 7382 |
| 1468 | AGAAACCUA UGACUUCU | 3236 | AGAAGUCA CUGAUGAGGNNNNNNNNCCGAA ACCUUUCU | 7383 |
| 1474 | GUAUGACUU CUGCACUG | 3237 | CAGUGCAG CUGAUGAGGNNNNNNNNCCGAA AGUCAUAC | 7384 |
| 1475 | UAUGACUUC UGCACUGA | 3238 | UCAGUGCA CUGAUGAGGNNNNNNNNCCGAA AAGUCAUA | 7385 |
| 1495 | UGAAGAAUC CUUUAUCC | 3239 | GGAUAAAG CUGAUGAGGNNNNNNNNCCGAA AUUCUUCA | 7386 |
| 1498 | AGAAUCCUU UAUCCUGG | 3240 | CCAGGAUA CUGAUGAGGNNNNNNNNCCGAA AGGAUUCA | 7387 |
| 1499 | GAAUCCUUU AUCCUGGA | 3241 | UCCAGGAU CUGAUGAGGNNNNNNNNCCGAA AAGGAUUC | 7388 |
| 1500 | AAUCCUUUA UCCUGGAU | 3242 | AUCCAGGA CUGAUGAGGNNNNNNNNCCGAA AAACCAUU | 7389 |
| 1502 | UCCUUUAUC CUGGAUCC | 3243 | GGAUCCAG CUGAUGAGGNNNNNNNNCCGAA AUAAAGGA | 7390 |
| 1509 | UCCUGGAUC CCAGCAGC | 3244 | GCUGCUGG CUGAUGAGGNNNNNNNNCCGAA AUCCAGGA | 7391 |
| 1522 | CAGCAACUU AGGAAACA | 3245 | UGUUUCCU CUGAUGAGGNNNNNNNNCCGAA AGUUGCUG | 7392 |
| 1523 | AGCAACUUA CCAAACAG | 3246 | CUGUUUCC CUGAUGAGGNNNNNNNNCCGAA AAGUUGCU | 7393 |
| 1535 | AACAGAAUU GAGAGCAU | 280 | AUGCUCUC CUGAUGAGGNNNNNNNNCCGAA AUUCUGUU | 4436 |
| 1544 | GAGAGCAUC UCUCAGCG | 3247 | CGCUGAGA CUGAUGAGGNNNNNNNNCCGAA AUGCUCUC | 7394 |
| 1546 | GAGCAUCUC UCAGCGCA | 3248 | UGCGCUCA CUGAUGAGGNNNNNNNNCCGAA AGAUGCUC | 7395 |
| 1548 | GCAUCUCUC AGCGCAUG | 3249 | CAUGCGCU CUGAUGAGGNNNNNNNNCCGAA AGAGAUGC | 7396 |
| 1562 | AUGACGGUC AUAGAAGG | 3250 | CCUUCUAU CUGAUGAGGNNNNNNNNCCGAA ACCGUCAU | 7397 |
| 1565 | ACGGUCAUA GAAGGAAC | 3251 | GUUCCUUC CUGAUGAGGNNNNNNNNCCGAA AUGACCGU | 7398 |
| 1578 | GAACAAAUA AGACGGUU | 3252 | AACCGUCU CUGAUGAGGNNNNNNNNCCGAA AUUUGUUC | 7399 |
| 1586 | AAGACGGUU AGCACAUU | 3253 | AAUGUGCU CUGAUGAGGNNNNNNNNCCGAA ACCGUCUU | 7400 |
| 1587 | AGACGGUUA GCACAUUG | 3254 | CAAUGUGC CUGAUGAGGNNNNNNNNCCGAA AACCGUCU | 7401 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 1594 | UAGCACAUU GGUGGUGG | 3255 | CCACCACC CUGAUGAGGNNNNNNNNCCGAA AUGUGCUA | 7402 |
| 1609 | GGCUGACUC UCAGACCC | 3256 | GGGUCUGA CUGAUGAGGNNNNNNNNCCGAA AGUCAGCC | 7403 |
| 1611 | CUGACUCUC AGACCCCU | 3257 | AGGGGUCU CUGAUGAGGNNNNNNNNCCGAA AGAGUCAG | 7404 |
| 1625 | CCUGGAAUC UACAGCUG | 3258 | CAGCUGUA CUGAUGAGGNNNNNNNNCCGAA AUUCCAGG | 7405 |
| 1627 | UGGAAUCUA CAGCUGCC | 3259 | GGCAGCUG CUGAUGAGGNNNNNNNNCCGAA AGAUUCCA | 7406 |
| 1642 | CCGGGCCUU CAAUAAAA | 3260 | UUUUAUUG CUGAUGAGGNNNNNNNNCCGAA AGGCCCGG | 7407 |
| 1643 | CGGGCCUUC AAUAAAAU | 3261 | AUUUUAUU CUGAUGAGGNNNNNNNNCCGAA AAGGCCCG | 7408 |
| 1647 | CCUUCAAUA AAAUAGGG | 3262 | CCCUAUUU CUGAUGAGGNNNNNNNNCCGAA AUUCAAGG | 7409 |
| 1652 | AAUAAAAUA GGGACUGU | 3263 | ACAGUCCC CUGAUGAGGNNNNNNNNCCGAA AUUUUAUU | 7410 |
| 1673 | AGAAACAUA AAAUUUUA | 3264 | UAAAAUUU CUGAUGAGGNNNNNNNNCCGAA AUGUUUCU | 7411 |
| 1678 | CAUAAAAUU UUAUGUCA | 3265 | UGACAUAA CUGAUGAGGNNNNNNNNCCGAA AUUUUAUG | 7412 |
| 1679 | AUAAAAUUU UAUGUCAC | 3266 | GUGACAUA CUGAUGAGGNNNNNNNNCCGAA AAUUUUAU | 7413 |
| 1680 | UAAAAUUUU AUGUCACA | 3267 | UGUGACAU CUGAUGAGGNNNNNNNNCCGAA AAAUUUUA | 7414 |
| 1681 | AAAAUUUUA UGUCACAG | 3268 | CUGUGACA CUGAUGAGGNNNNNNNNCCGAA AAAAUUUU | 7415 |
| 1685 | UUUUAUGUC ACAGAUGU | 3269 | ACAUCUGU CUGAUGAGGNNNNNNNNCCGAA ACAUAAAA | 7416 |
| 1705 | GAAUGGCUU UCACGUUU | 3270 | AAACGUCA CUGAUGAGGNNNNNNNNCCGAA AGCCAUUC | 7417 |
| 1706 | AAUGGCUUU CACGUUUC | 3271 | GAAACGUG CUGAUGAGGNNNNNNNNCCGAA AAGCCAUU | 7418 |
| 1707 | AUGGCUUUC ACGUUUCC | 3272 | GGAAACGU CUGAUGAGGNNNNNNNNCCGAA AAAGCCAU | 7419 |
| 1712 | UUUCACGUU UCCUUGGA | 3273 | UCCAAGGA CUGAUGAGGNNNNNNNNCCGAA ACGUGAAA | 7420 |
| 1713 | UUCACGUUU CCUUGGAA | 3274 | UUCCAAGG CUGAUGAGGNNNNNNNNCCGAA AACGUCAA | 7421 |
| 1714 | UCACGUUUC CUUGGAAA | 3275 | UUUCCAAG CUGAUGAGGNNNNNNNNCCGAA AAACGUGA | 7422 |
| 1717 | CGUUUCCUU GGAAAAGA | 3276 | UCUUUUCC CUGAUGAGGNNNNNNNNCCGAA AGGAAACG | 7423 |
| 1756 | GAAACUGUC CUGUGUGG | 3277 | CCACACAG CUGAUGAGGNNNNNNNNCCGAA ACAGUUUC | 7424 |
| 1766 | UGUGUGGUC AAUAAAUU | 3278 | AAUUUAUU CUGAUGAGGNNNNNNNNCCGAA ACCACACA | 7425 |
| 1770 | UGGUCAAUA AAUUCCUG | 3279 | CA55AAUU CUGAUGAGGNNNNNNNNCCGAA AUUGACCA | 7426 |
| 1774 | CAAUAAAUU CCUGUACA | 3280 | UGUACAGG CUGAUGAGGNNNNNNNNCCGAA AUUUAUUG | 7427 |
| 1775 | AAUAAAUUC CUGUACAG | 3281 | CUGUACAG CUGAUGAGGNNNNNNNNCCGAA AAUUUAUU | 7428 |
| 1780 | AUUCCUGUA CAGAGACA | 3282 | UGUCUCUG CUGAUGAGGNNNNNNNNCCGAA ACAGGAAU | 7429 |
| 1790 | AGAGACAUU ACCUGGAC | 3283 | AUCCAGGU CUGAUGAGGNNNNNNNNCCGAA AUGUCUCU | 7430 |
| 1791 | GAGACAUUA CCUGGAUU | 3284 | AAUCCAGG CUGAUGAGGNNNNNNNNCCGAA AAUGUCUC | 7431 |
| 1799 | ACCUGGAUU CUGCUACG | 3285 | CGUAGCAG CUGAUGAGGNNNNNNNNCCGAA AUCCAGGU | 7432 |
| 1800 | CCUGGAUUC UGCUACGG | 3286 | CCGUAGCA CUGAUGAGGNNNNNNNNCCGAA AAUCCAGG | 7433 |
| 1805 | AUUCUGCUA CGGACACU | 3287 | ACUGUCCG CUGAUGAGGNNNNNNNNCCGAA AGCAGAAU | 7434 |
| 1814 | CGGACAGUU AACAACAG | 3288 | CUGUUGUU CUGAUGAGGNNNNNNNNCCGAA ACUGUCCG | 7435 |
| 1815 | GGACAGUUA ACAACAGA | 3289 | UCUGUUGU CUGAUGAGGNNNNNNNNCCGAA AACUGUCC | 7436 |
| 1836 | UGCACCAUA GUAUCAGC | 3290 | GCUGAUAC CUGAUGAGGNNNNNNNNCCGAA AUGGUGCA | 7437 |
| 1839 | ACCAUAGUA UCAGCAAG | 3291 | CUUGCUGA CUGAUGAGGNNNNNNNNCCGAA ACUAUGGU | 7438 |
| 1841 | CAUAGUAUC AGCAAGCA | 3292 | UGCUUGCU CUGAUGAGGNNNNNNNNCCGAA AUACUAUG | 7439 |
| 1866 | CCACCACUC AAGAUUAC | 3293 | GUAAUCUU CUGAUGAGGNNNNNNNNCCGAA AGUGGUGG | 7440 |
| 1872 | CUCAAGAUU ACUCCAUC | 3294 | GAUGGAGU CUGAUGAGGNNNNNNNNCCGAA AUCUUGAG | 7441 |
| 1873 | UCAAGAUUA CUCCAUCA | 3295 | UGAUGGAG CUGAUGAGGNNNNNNNNCCGAA AAUCUUGA | 7442 |
| 1876 | AGAUUACUC CAUCACUC | 3296 | GAGUGAUG CUGAUGAGGNNNNNNNNCCGAA AGUAAGCU | 7443 |
| 1880 | UACUCCUAC ACUCUGAA | 3297 | UUCAGAGU CUGAUGAGGNNNNNNNNCCGAA AUGGAGUA | 7444 |
| 1884 | CCAUCACUC UGAACCUU | 3298 | AAGGUUCA CUGAUGAGGNNNNNNNNCCGAA AGUGAUGG | 7445 |
| 1892 | CUGAACCUU GUCAUCAA | 3299 | UUGAUGAC CUGAUGAGGNNNNNNNNCCGAA AGGUUCAG | 7446 |
| 1895 | AACCUUGUC AUCAAGAA | 3300 | UUCUUGAU CUGAUGAGGNNNNNNNNCCGAA ACAAGGUU | 7447 |
| 1898 | CUUGUCAUC AAGAACGU | 3301 | ACGUUCUU CUGAUGAGGNNNNNNNNCCGAA AUGACAAG | 7448 |
| 1909 | GAACGUGUC UCUAGAAG | 3302 | CUUCUAGA CUGAUGAGGNNNNNNNNCCGAA ACACGUUC | 7449 |
| 1911 | ACGUGUCUC UAGAAGAC | 3303 | GUCUUCUA CUGAUGAGGNNNNNNNNCCGAA AGACACGU | 7450 |
| 1913 | GUGUCUCUA GAAGACUC | 3304 | GAGUCUUC CUGAUGAGGNNNNNNNNCCGAA AGAGACAC | 7451 |
| 1921 | AGAAGACUC GGGCACCU | 3305 | AGGUGCCC CUGAUGAGGNNNNNNNNCCGAA AGUCUUCU | 7452 |
| 1930 | GGGCACCUA UGCGUGCA | 3306 | UGCACGCA CUGAUGAGGNNNNNNNNCCGAA AGGUGCCC | 7453 |
| 1952 | AGGAACAUA UACACAGG | 3307 | CCUGUGUA CUGAUGAGGNNNNNNNNCCGAA AUGUUCCU | 7454 |
| 1954 | GAACAUAUA CACAGGGG | 3308 | CCCCUGUG CUGAUGAGGNNNNNNNNCCGAA AUAUGUUC | 7455 |
| 1970 | GAAGACAUC CUUCGGAA | 3309 | UUCCGAAG CUGAUGAGGNNNNNNNNCCGAA AUGUCUUC | 7456 |
| 1973 | GACAUCCUU CGGAAGAC | 3310 | GUCUUCCG CUGAUGAGGNNNNNNNNCCGAA AGGAUGUC | 7457 |
| 1974 | ACAUCCUUC GGAAGACA | 3311 | UGUCUUCC CUGAUGAGGNNNNNNNNCCGAA AAGGAUGU | 7458 |
| 1988 | ACAGAAGUU C7GUUAG | 3312 | CUAACGAG CUGAUGAGGNNNNNNNNCCGAA ACUUCUGU | 7459 |
| 1989 | CAGAAGUUC UCGUUAGA | 3313 | UCUAACGA CUGAUGAGGNNNNNNNNCCGAA AACUUCUG | 7460 |
| 1991 | GAAGUUCUC GUUAGAGA | 3314 | UCUCUAAC CUGAUGAGGNNNNNNNNCCGAA AGAACUUC | 7461 |
| 1994 | GUUCUCGUU AGAGAUUC | 3315 | GAAUCUCU CUGAUGAGGNNNNNNNNCCGAA ACGAGAAC | 7462 |
| 1995 | UUCUCGUUA GAGAUUCG | 3316 | CGAAUCUC CUGAUGAGGNNNNNNNNCCGAA AACGACAA | 7463 |
| 2001 | UUAGAGAUU CGGAAGCG | 3317 | CGCUUCCG CUGAUGAGGNNNNNNNNCCGAA AUCUCUAA | 7464 |
| 2002 | UAGAGAUUC GGAAGCGC | 3318 | GCGCUUCC CUGAUGAGGNNNNNNNNCCGAA AAUCUCUA | 7465 |
| 2021 | CACCUGCUU CAAAACCU | 3319 | AGGUUUUG CUGAUGAGGNNNNNNNNCCGAA AGCAGGUG | 7466 |
| 2022 | ACCUGCUUC AAAACCUC | 3320 | GAGGUUUU CUGAUGAGGNNNNNNNNCCGAA AAGCAGGU | 7467 |
| 2030 | CAAAACCUC AGUGACUA | 3321 | UAGUCACU CUGAUGAGGNNNNNNNNCCGAA AGGUUUUG | 7468 |
| 2038 | CAGUGACUA CGACCUCU | 3322 | AGACCUCG CUGAUGAGGNNNNNNNNCCGAA AGUCACUG | 7469 |
| 2045 | UACGAGGUC UCCAUCAG | 3323 | CUGAUGGA CUGAUGAGGNNNNNNNNCCGAA ACCUCGUA | 7470 |
| 2047 | CGAGGUCUC CAUCAGUG | 3324 | CACUGAUG CUGAUGAGGNNNNNNNNCCGAA AGACCUCG | 7471 |
| 2051 | GUCUCCAUC AGUGGCUC | 3325 | GAGCCACU CUGAUGAGGNNNNNNNNCCGAA AUGGAGAC | 7472 |
| 2059 | CAGUGGCUC UACGACCU | 3326 | AGGUCGUA CUGAUGAGGNNNNNNNNCCGAA AGCCACUG | 7473 |
| 2061 | GUGGCUCUA CGACCUUA | 3327 | UAAGGUCG CUGAUGAGGNNNNNNNNCCGAA AGAGCCAC | 7474 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 2068 | UACGACCUU AGACUGUC | 3328 | GACAGUAU CUGAUGAGGNNNNNNNNCCGAA AGGUCGUA | 7475 |
| 2069 | ACGACCUUA GACUGUCA | 3329 | UGACAGUC CUGAUGAGGNNNNNNNNCCGAA AAGGUCGU | 7476 |
| 2076 | UAGACUGUC AAGCUAGA | 3330 | UCUAGCUU CUGAUGAGGNNNNNNNNCCGAA ACAGUCUA | 7477 |
| 2082 | GUCAAGCUA GAGGUGUC | 3331 | GACACCUC CUGAUGAGGNNNNNNNNCCGAA AGCUUGAC | 7478 |
| 2090 | AGAGGUGUC CCCGCGCC | 3332 | GGCGCGGG CUGAUGAGGNNNNNNNNCCGAA ACACCUCU | 7479 |
| 2100 | CCGCGCCUC AGAUCACU | 3333 | AGUGAUCU CUGAUGAGGNNNNNNNNCCGAA AGGCGCGG | 7480 |
| 2105 | CCUCAGAUC ACUUGGUU | 378 | AACCAAGU CUGAUGAGGNNNNNNNNCCGAA AUCUGAGG | 4534 |
| 2109 | AGAUCACUU GGUUCAAA | 3334 | UUUGAACC CUGAUGAGGNNNNNNNNCCGAA AGUGAUCU | 7481 |
| 2113 | CACUUGGUU CAAAACA | 3335 | UGUUUUG CUGAUGAGGNNNNNNNNCCGAA ACCAAGUG | 7482 |
| 2114 | ACUUGGUUC AAAAACAA | 3336 | UUGUUUUU CUGAUGAGGNNNNNNNNCCGAA AACCAAGU | 4537 |
| 2132 | CACAAAAUA CAACAAGA | 383 | UCUUGUUG CUGAUGAGGNNNNNNNNCCGAA AUUUUGUG | 4539 |
| 2150 | CCGGGAAUU AUUUUAGG | 3337 | CCUAAAAU CUGAUGAGGNNNNNNNNCCGAA AUUCCCGG | 7483 |
| 2151 | CGGGAAUUA UUUUAGGA | 3338 | UCCUAAAA CUGAUGAGGNNNNNNNNCCGAA AAUUCCCG | 7484 |
| 2153 | GGAAUUAUU UUAGGACC | 386 | GGUCCUAA CUGAUGAGGNNNNNNNNCCGAA AUAAUUCC | 4542 |
| 2154 | GAAUUAUUU UAGGACCA | 387 | UGGUCCUA CUGAUGAGGNNNNNNNNCCGAA AAUAAUUC | 4543 |
| 2155 | AAUUAUUUU AGGACCAG | 388 | CUGGUCCU CUGAUGAGGNNNNNNNNCCGAA AAAUAAUU | 4544 |
| 2156 | AUUAUUUUA GGACCAGG | 389 | CCUGGUCC CUGAUGAGGNNNNNNNNCCGAA AAAAUAAU | 4545 |
| 2179 | CACGCUAUU UAUUGAAA | 390 | UUUCAAUA CUGAUGAGGNNNNNNNNCCGAA ACAGCGUG | 4546 |
| 2180 | ACGCUGUUU AUUGAAAG | 391 | CUUUCAAU CUGAUGAGGNNNNNNNNCCGAA AACAGCGU | 4547 |
| 2181 | CGCUGUUUA UUGAAAGA | 392 | UCUUUCAA CUGAUGAGGNNNNNNNNCCGAA AAACAGCG | 4548 |
| 2183 | CUGUUUAUU GAAAGAGU | 393 | ACUCUUUC CUGAUGAGGNNNNNNNNCCGAA AUAAACAG | 4549 |
| 2192 | GAAAGAGUC ACAGAGGA | 3339 | UCCUCUGU CUGAUGAGGNNNNNNNNCCGAA ACUCUUUC | 7485 |
| 2213 | GAGGGUGUC UAUAGGUG | 3340 | CACCUAUA CUGAUGAGGNNNNNNNNCCGAA ACACCCUC | 7486 |
| 2215 | GGGUGUCUA UAGGUGCC | 3341 | GGCACCUA CUGAUGAGGNNNNNNNNCCGAA AGACACCC | 7487 |
| 2217 | GUGUCUAUA GGUGCCGA | 3342 | UCGGCACC CUGAUGAGGNNNNNNNNCCGAA AUAGACAC | 7488 |
| 2263 | CGCAGCCUA CCUCACCG | 3343 | CGGUGAGG CUGAUGAGGNNNNNNNNCCGAA AGGCUGCG | 7489 |
| 2267 | GCCUACCUC ACCGUGCA | 3344 | UGCACGGU CUGAUGAGGNNNNNNNNCCGAA AGGUAGGC | 7490 |
| 2284 | AGGAACCUC AGACAAGU | 3345 | ACUUGUCU CUGAUGAGGNNNNNNNNCCGAA AGGUUCCU | 7491 |
| 2293 | AGACAAGUC AAACCUGG | 3346 | CCAGGUUU CUGAUGAGGNNNNNNNNCCGAA ACUUGUCU | 7492 |
| 2309 | GAGCUGAUC ACGCUCAC | 3347 | GUGAGCGU CUGAUGAGGNNNNNNNNCCGAA AUCAGCUC | 7493 |
| 2315 | AUCACGCUC ACGUGCAC | 3348 | GUGCACGU CUGAUGAGGNNNNNNNNCCGAA AGCGUGAU | 7494 |
| 2342 | GCGACCCUC UUUUGGCU | 3349 | AGCCAAAA CUGAUGAGGNNNNNNNNCCGAA AGGGUCGC | 7495 |
| 2344 | GACCCUCUU UUGGCUCC | 3350 | GGAGCCAA CUGAUGAGGNNNNNNNNCCGAA AGAGGGUC | 7496 |
| 2345 | ACCCUCUUU UGGCUCCU | 3351 | AGGAGCCA CUGAUGAGGNNNNNNNNCCGAA AAGAGGGU | 7497 |
| 2346 | CCCUCUUUU GGCUCCUU | 3352 | AAGGAGCC CUGAUGAGGNNNNNNNNCCGAA AAAGAGGG | 7498 |
| 2351 | UUUUGGCUC CUUCUAAC | 3353 | GUUAGAAG CUGAUGAGGNNNNNNNNCCGAA AGCCAAAA | 7499 |
| 2354 | UGGCUCCUU CUAACUCU | 3354 | AGAGUUAG CUGAUGAGGNNNNNNNNCCGAA AGGAGCCA | 7500 |
| 2355 | GGCUCCUUC UAACUCUC | 3355 | GAGAGUUA CUGAUGAGGNNNNNNNNCCGAA AAGGAGCC | 7501 |
| 2357 | CUCCUUCUA ACUCUCUU | 3356 | AAGAGAGU CUGAUGAGGNNNNNNNNCCGAA AGAAGGAG | 7502 |
| 2361 | UUCUAACUC UCUUCAUC | 3357 | GAUGAAGA CUGAUGAGGNNNNNNNNCCGAA AGUUAGAA | 7503 |
| 2363 | CUAACUCUC UUCAUCAG | 3358 | CUGAUGAA CUGAUGAGGNNNNNNNNCCGAA AGAGUUAG | 7504 |
| 2365 | AACUCUCUU CAUCAGAA | 3359 | UUCUGAUG CUGAUGAGGNNNNNNNNCCGAA AGAGACUU | 7505 |
| 2366 | ACUCUCUUC AUCAGAAA | 3360 | UUUCUGAU CUGAUGAGGNNNNNNNNCCGAA AAGAGAGU | 7506 |
| 2369 | CUCUUCAUC AGAAACU | 3361 | AGUUUCU CUGAUGAGGNNNNNNNNCCGAA AUGAAGAG | 7507 |
| 2386 | GAAGCGGUC UUCUUCCG | 3362 | CGGAAGAA CUGAUGAGGNNNNNNNNCCGAA ACCGCUUC | 7508 |
| 2388 | AGCGGUCUU CUUCCGAA | 3363 | UUCGGAAG CUGAUGAGGNNNNNNNNCCGAA AGACCGCU | 7509 |
| 2389 | GCGGUCUUC UUCCGAAG | 3364 | CUUCGGAA CUGAUGAGGNNNNNNNNCCGAA AAGACCGC | 7510 |
| 2391 | GGUCUUCUU CCGAAGUC | 3365 | UACUUCGG CUGAUGAGGNNNNNNNNCCGAA AGAAGACC | 7511 |
| 2392 | GUCUUCUUC CGAAGUAA | 3366 | UUACUUCG CUGAUGAGGNNNNNNNNCCGAA AAGAAGAC | 7512 |
| 2399 | UCCGAAGUA AACACAGA | 3367 | UCUGUCUU CUGAUGAGGNNNNNNNNCCGAA ACUUCGGA | 7513 |
| 2410 | GACAGACUA CCUGUCAA | 3368 | UUGACAGG CUGAUGAGGNNNNNNNNCCGAA AGUCUGUC | 7514 |
| 2416 | CUACCUGUC AAUCAUUA | 3369 | UAAUGAUU CUGAUGAGGNNNNNNNNCCGAA ACAGGUAG | 7515 |
| 2420 | CUGUCAAUC AUUAUGGA | 3370 | UCCAUCCU CUGAUGAGGNNNNNNNNCCGAA AUUGACAG | 7516 |
| 2423 | UCAAUCAUU AUGGACCC | 3371 | GGGUCCAU CUGAUGAGGNNNNNNNNCCGAA AUGAUUGA | 7517 |
| 2424 | CAAUCAUUA UGGACCCA | 3372 | UGGGUCCA CUGAUGAGGNNNNNNNNCCGAA AAUGAUUG | 7518 |
| 2441 | GAUGAAGUU CCCUGGA | 3373 | UCCAGGGG CUGAUGAGGNNNNNNNNCCGAA ACUUCAUC | 7519 |
| 2442 | AUGAAGUUC CCUGGAU | 3374 | AUCCAGGG CUGAUGAGGNNNNNNNNCCGAA AACUUCAU | 7520 |
| 2473 | GCUGCCCUA UGAUGCCA | 3375 | UGGCAUCA CUGAUGAGGNNNNNNNNCCGAA AGGGCAGC | 7521 |
| 2494 | GUGGGAGUU UGCACGGG | 3376 | CCCGUGCA CUGAUGAGGNNNNNNNNCCGAA ACUCCCAC | 7522 |
| 2495 | UGGGAGUUU GCACGGGA | 3377 | UCCCGUGC CUGAUGAGGNNNNNNNNCCGAA AACUCCCA | 7523 |
| 2516 | CUGAAACUA GGCAAAUC | 3378 | GAUUUGCC CUGAUGAGGNNNNNNNNCCGAA AGUUUCAG | 7524 |
| 2524 | AGGCAAAUC GCUCGGAA | 3379 | UUCCGAGC CUGAUGAGGNNNNNNNNCCGAA AUUUGCCU | 7525 |
| 2528 | AAAUCGCUC GGAAGAGG | 3380 | CCUCUUCC CUGAUGAGGNNNNNNNNCCGAA AGCGAUUU | 7526 |
| 2541 | GAGGGGCUU UUGGGAAA | 3381 | UUUCCCAA CUGAUGAGGNNNNNNNNCCGAA AGCCCCUC | 7527 |
| 2542 | AGGGGCUUU UGGGAAAG | 3382 | CUUUCCCA CUGAUGAGGNNNNNNNNCCGAA AAGCCCCU | 7528 |
| 2543 | GGGGCUUUU GGGAAAGU | 3383 | ACUUUCCC CUGAUGAGGNNNNNNNNCCGAA AAAGCCCC | 7529 |
| 2552 | GGGAAAGUC GUUCAAGC | 3384 | GCUUGAAC CUGAUGAGGNNNNNNNNCCGAA ACUUUCCC | 7530 |
| 2555 | AAACUCGUC CAAGCCUC | 3385 | GAGGCUUG CUGAUGAGGNNNNNNNNCCGAA ACGACUUU | 7531 |
| 2556 | AAGUCGUUC AAGCCUCU | 3386 | AGAGGCUU CUGAUGAGGNNNNNNNNCCGAA AACGACUU | 7532 |
| 2563 | UCAAGCCUC UGCAUUUG | 3387 | CAAAUGCA CUGAUGAGGNNNNNNNNCCGAA AGGCUUGA | 7533 |
| 2569 | CUCUGCAUU UGGCAUUA | 3388 | UAAUGCCA CUGAUGAGGNNNNNNNNCCGAA AUGCAGAG | 7534 |
| 2570 | UCUGCAUUU GGCAUUAA | 3389 | UUAAUGCC CUGAUGAGGNNNNNNNNCCGAA AAUCCAGA | 7535 |
| 2576 | UUUGGCAUU AAGAAAUC | 457 | GAUUUCUU CUGAUGAGGNNNNNNNNCCGAA AUCGCAAA | 4613 |

TABLE VIII-continued

Mouse *flt*-1 VEGF Receptor-Hammerhead Ribozyme and Substrate Sequence

| Pos | Substrate | Seq ID No | HH Ribozyme Sequence | Seq ID No |
|---|---|---|---|---|
| 2577 | UUGGCAUUA AGAAAUCA | 458 | UGAUUUCU CUGAUGAGGNNNNNNNNCCGAA AAUGCCAA | 4614 |
| 2584 | UAAGAAAUC ACCCACCU | 3390 | AGGUGGGU CUGAUGAGGNNNNNNNNCCGAA AUUUCUUA | 7536 |
| 2617 | GAAGAUGUU GAAAGAGG | 3391 | CCUCUUUC CUGAUGAGGNNNNNNNNCCGAA ACAUCUUC | 7537 |
| 2644 | CAGUGAGUA CAAAGCUC | 3392 | GAGCUUUG CUGAUGAGGNNNNNNNNCCGAA ACUCACUG | 7538 |
| 2652 | ACAAAGCUC UGUUGACC | 3393 | GGUCAACA CUGAUGAGGNNNNNNNNCCGAA AGCUUUGU | 7539 |
| 2666 | ACCGAACUC AAGAUCUU | 3394 | AAGAUCUU CUGAUGAGGNNNNNNNNCCGAA AGUUCGGU | 7540 |
| 2672 | CUCAAGAUC UUGACCCA | 3395 | UGGGUCAA CUGAUGAGGNNNNNNNNCCGAA AUCUUGAG | 7541 |
| 2674 | CAAGAUCUU GACCCACA | 3396 | UGUGGGUC CUGAUGAGGNNNNNNNNCCGAA AGAUCUUG | 7542 |
| 2684 | ACCCACAUC GGCCAUCA | 3397 | UGAUGGCC CUGAUGAGGNNNNNNNNCCGAA AUCUGGGU | 7543 |
| 2691 | UCGGCGAUC AUCUGAAU | 3398 | AUUCAGAU CUGAUGAGGNNNNNNNNCCGAA AUCGCCGA | 7544 |
| 2694 | GCCAUCAUC UGAAUGUG | 3399 | CACAUUCA CUGAUGAGGNNNNNNNNCCGAA AUGGUGGC | 7545 |
| 2705 | AAUGUGGUU AACCUCCU | 3400 | AGGAGGUU CUGAUGAGGNNNNNNNNCCGAA ACCACAUU | 7546 |
| 2706 | AUGUGGUUA ACCUCCUG | 3401 | ACGGAGGU CUGAUGAGGNNNNNNNNCCGAA ACCAACAU | 7547 |
| 2711 | GUUAACCUC CUGGGAGC | 3402 | GCUCCCAG CUGAUGAGGNNNNNNNNCCGAA AACCUAAC | 7548 |
| 2742 | GAGGGCCUC UGACGGUG | 470 | CACCAUCA CUGAUGAGGNNNNNNNNCCGAA AGGCCCUC | 4626 |
| 2753 | AUGGUGAUC GUGGAAUA | 3403 | UAUUCCAC CUGAUGAGGNNNNNNNNCCGAA AUCACCAU | 7549 |
| 2761 | CGUGGAAUA CUGCAAAU | 3404 | AUUUGCAG CUGAUGAGGNNNNNNNNCCGAA AUCACACG | 7550 |
| 2770 | CUGCAAAUA CGGAAACC | 3405 | GGUUUCCG CUGAUGAGGNNNNNNNNCCGAA AUUCGCAG | 7551 |
| 2782 | AAACCUGUC CAACUACC | 3406 | GGUAGUUG CUGAUGAGGNNNNNNNNCCGAA AUUUGUUU | 7552 |
| 2788 | GUCCAACUA CCUCAAGA | 3407 | UCUUGAGG CUGAUGAGGNNNNNNNNCCGAA ACAGGGAC | 7553 |
| 2792 | AACUACCUC AAGAGCAA | 479 | UUGCUCUU CUGAUGAGGNNNNNNNNCCGAA AGUUAGUU | 4635 |
| 2809 | ACGUGACUU AUUCUGUC | 3408 | GACAGAAU CUGAUGAGGNNNNNNNNCCGAA AGGUACGU | 7554 |
| 2810 | CGUCACUUA CCGUGUCU | 3409 | AGACAGAA CUGAUGAGGNNNNNNNNCCGAA AGUCCACG | 7555 |
| 2812 | UGACUUAUU CUGUCUCA | 3410 | UGAGACAG CUGAUGAGGNNNNNNNNCCGAA AUAAGUCA | 7556 |
| 2813 | GACUUAUUC UGUCUCAA | 3411 | UUGAGACA CUGAUGAGGNNNNNNNNCCGAA AUAAAGUC | 7557 |
| 2817 | UAUUCUGUC UCAACAAG | 3412 | CUUGUUGA CUGAUGAGGNNNNNNNNCCGAA ACAGAAUA | 7558 |
| 2819 | UUCUGUCUC AACAUGGA | 3413 | UCCUUGUU CUGAUGAGGNNNNNNNNCCGAA ACAGAGAA | 7559 |
| 2836 | CGCAGCCUU GCAUAUGG | 3414 | CCAUAUGC CUGAUGAGGNNNNNNNNCCGAA AGGCUGCG | 7560 |
| 2841 | CCUUGCAUA UGGAGCUC | 3415 | GAGCUCCA CUGAUGAGGNNNNNNNNCCGAA AUGCAAGG | 7561 |
| 2849 | AUGGAGCUC AAGAAAGA | 3416 | UCUUUCUU CUGAUGAGGNNNNNNNNCCGAA AGCUCCAU | 7562 |
| 2900 | CCCCGCCUA GACAGUGU | 3417 | AGAGUGUC CUGAUGAGGNNNNNNNNCCGAA AGGCGGGG | 7563 |
| 2909 | GACAGUGUC AGCAGCUC | 3418 | GAGCUGCU CUGAUGAGGNNNNNNNNCCGAA ACACUGUC | 7564 |
| 2917 | CAGCAGCUC AAGUGUCA | 3419 | UGACACUU CUGAUGAGGNNNNNNNNCCGAA AGCUGCUG | 7565 |
| 2924 | UCAAGUGUC ACCAGCUC | 3420 | GAGCUGGU CUGAUGAGGNNNNNNNNCCGAA ACACUUGA | 7566 |
| 2932 | CACCAGCUC CAGCUUCC | 3421 | GGAAGCUG CUGAUGAGGNNNNNNNNCCGAA AGCUGGUG | 7567 |
| 2938 | CUCCAGCUU CCCUGAAG | 3422 | CUUCAGGG CUGAUGAGGNNNNNNNNCCGAA AGCUGGAG | 7568 |
| 2939 | UCCAGCUUC CCUGAAGA | 3423 | UCUUCAGG CUGAUGAGGNNNNNNNNCCGAA AAGCUGGA | 7569 |
| 2982 | ACGAGGAUU ACAGUGAG | 3424 | CUCACUGU CUGAUGAGGNNNNNNNNCCGAA AUCCUCGU | 7570 |
| 2983 | CGAGGAUUA CAGUGAGA | 3425 | UCUCACUG CUGAUGAGGNNNNNNNNCCGAA AAUCCUCG | 7571 |
| 2993 | AGUGAGAUC UCCAAGCA | 3426 | UGCUUGGA CUGAUGAGGNNNNNNNNCCGAA AUCUCACU | 7572 |
| 2995 | UGAGAUCUC CAAGCAGC | 3427 | GCUGCUUG CUGAUGAGGNNNNNNNNCCGAA AGAUCUCA | 7573 |
| 3008 | CAGCCCCUC ACCAUGGA | 3428 | UCCAUGGU CUGAUGAGGNNNNNNNNCCGAA AGGGGCUG | 7574 |
| 3026 | GACCUGAUU UCCUACAG | 3429 | GUCUAGGA CUGAUGAGGNNNNNNNNCCGAA AUCAGGUC | 7575 |
| 3027 | ACCUGAUUU CCUACAGU | 3430 | ACUGUAGG CUGAUGAGGNNNNNNNNCCGAA AAUCAGGU | 7576 |
| 3028 | CCUGAUUUC CUACAGUU | 3431 | AACUGUAG CUGAUGAGGNNNNNNNNCCGAA AAAUCAGG | 7577 |
| 3031 | GAUUUCCUA CAGUUCC | 3432 | GGAAACUG CUGAUGAGGNNNNNNNNCCGAA AGGAAAUC | 7578 |
| 3036 | CCUACAGUU UCCAAGUG | 3433 | CACUUGGA CUGAUGAGGNNNNNNNNCCGAA ACUGUAGG | 7579 |
| 3037 | CUACAGUUU CCAAGUGG | 3434 | CCACUUGG CUGAUGAGGNNNNNNNNCCGAA AACUGUAG | 7580 |
| 3038 | UACAGUUUC CAAGUGGC | 3435 | GCCACUUG CUGAUGAGGNNNNNNNNCCGAA AAACUGUA | 4675 |
| 3061 | CAUGGAGUU UCUGUCCU | 3436 | AGGACAGA CUGAUGAGGNNNNNNNNCCGAA ACUCCAUG | 7581 |
| 3062 | AUGGAGUUU CUGUCCUC | 3437 | GAGGACAG CUGAUGAGGNNNNNNNNCCGAA AACUCCAU | 7582 |
| 3063 | UGGAGUUUC UGUCCUCC | 3438 | GGAGGACA CUGAUGAGGNNNNNNNNCCGAA AAACUCCA | 7583 |
| 3067 | GUUUUUGUC CUCCAGAA | 3439 | UUCUGGAG CUGAUGAGGNNNNNNNNCCGAA ACAGAAAC | 7584 |
| 3070 | UCUGUCCUC CAGAAAGU | 3440 | ACUUUCUG CUGAUGAGGNNNNNNNNCCGAA AGGACAGA | 7585 |
| 3083 | AAGUGCAUU CAUCGGGU | 526 | UCCCGAUG CUGAUGAGGNNNNNNNNCCGAA AUGCACUU | 4682 |
| 3084 | AGUGCAUUC AUCGGGAC | 527 | GUCCCGAU CUGAUGAGGNNNNNNNNCCGAA AAUGCACU | 4683 |
| 3087 | GCAUUCAUC GGGACCUG | 528 | CAGGUCCC CUGAUGAGGNNNNNNNNCCGAA AUGAAUGC | 4684 |
| 3110 | AGAAACAUC CUUUUAUC | 3441 | GAUAAAAG CUGAUGAGGNNNNNNNNCCGAA AUGUUUCU | 4685 |
| 3113 | AACAUCCUU UUAUCUGA | 3442 | UCAGAUAA CUGAUGAGGNNNNNNNNCCGAA AGGAUGUU | 7586 |
| 3114 | ACAUCCUUU UAUCUGAG | 3443 | CUCAGAUA CUGAUGAGGNNNNNNNNCCGAA AAGGAUGU | 7587 |
| 3115 | CAUCCUUUU AUCUGAGA | 3444 | UCUCAGAU CUGAUGAGGNNNNNNNNCCGAA AAAGGAUG | 7588 |
| 3116 | AUCCUUUUA UCUGAGAA | 3445 | UUCUCAGA CUGAUGAGGNNNNNNNNCCGAA AAAAGGAU | 7589 |
| 3118 | CCUUUUAUC UGAGAACA | 3446 | UGUUCUCA CUGAUGAGGNNNNNNNNCCGAA AUAAAAGG | 7590 |
| 3140 | GUGAAGAUU UGCGACUU | 3447 | AAGUCGCA CUGAUGAGGNNNNNNNNCCGAA AUCUUCAC | 7591 |
| 3141 | UGAAGAUUU GCGACUUU | 3448 | AAAGUCGC CUGAUGAGGNNNNNNNNCCGAA AAUCUUCA | 7592 |
| 3148 | UUGCGACUU UGGCCUGG | 3449 | CCAGGCCA CUGAUGAGGNNNNNNNNCCGAA AGUCGCAA | 7593 |
| 3149 | UGCGACUUU GGCCUGGC | 3450 | GCCAGGCC CUGAUGAGGNNNNNNNNCCGAA AAGUCGCA | 7594 |
| 3165 | CCCGGGAUA UUUAUAAG | 542 | CUUAUAAA CUGAUGAGGNNNNNNNNCCGAA AUCCCGGG | 4698 |
| 3167 | CGGGAUAUU UAUAAGAA | 543 | UUCUUAUA CUGAUGAGGNNNNNNNNCCGAA AUAUCCCG | 4699 |
| 3168 | GGGAUAUUU AUAAGAAC | 544 | GUUCUUAU CUGAUGAGGNNNNNNNNCCGAA AAUAUCCC | 4700 |
| 3169 | GGAUAUUUA UAAGAACC | 545 | GGUUCUUA CUGAUGAGGNNNNNNNNCCGAA AAAUAUCC | 4701 |
| 3171 | AUAUUUAUA AGAACCCU | 3451 | AGGGUUCU CUGAUGAGGNNNNNNNNCCGAA AUAAAUAU | 7595 |
| 3183 | ACCCUGAUU AUGUGAGG | 3452 | CCUCACAU CUGAUGAGGNNNNNNNNCCGAA AUCAGGGU | 7596 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 3184 | CCCUGUAAU UGUGAGGA | 3453 | UCCUCACA CUGAUGAGGNNNNNNNNCCGAA AAUCAGGG | 7597 |
| 3201 | GAGGAGAUA CUCGACUU | 3454 | AAGUCGAG CUGAUGAGGNNNNNNNNCCGAA AUCUCCUC | 7598 |
| 3204 | GAGAUACUC GACUUCCC | 3455 | GGGAAGUC CUGAUGAGGNNNNNNNNCCGAA AGUAUCUC | 7599 |
| 3209 | ACUCGACUU CCCCUAAA | 3456 | UUUAGGGG CUGAUGAGGNNNNNNNNCCGAA AGUCGAGU | 7600 |
| 3210 | CUCGACUUC CCCUAAAA | 3457 | UUUUAGGG CUGAUGAGGNNNNNNNNCCGAA AAGUCGAG | 7601 |
| 3215 | CUUCCCCUA AAAUGGAU | 3458 | AUCCAUUU CUGAUGAGGNNNNNNNNCCGAA AGGGGAAG | 7602 |
| 3228 | GGAUGGCUC CUGAAUCC | 3459 | GGAUUCAG CUGAUGAGGNNNNNNNNCCGAA AGCCAUCC | 7603 |
| 3235 | UCCAGAAUC CAUCUUUG | 3460 | CAAAGAUG CUGAUGAGGNNNNNNNNCCGAA AUUCAGGA | 7604 |
| 3239 | GAAUCCAUC UUUGACAA | 3461 | UUGUCAAA CUGAUGAGGNNNNNNNNCCGAA AUGGAUUC | 7605 |
| 3241 | AUCCAUCUU UGACAAGG | 3462 | CCUUGUCA CUGAUGAGGNNNNNNNNCCGAA AGAUGGAU | 7606 |
| 3242 | UCCAUCUUU GACAAGGU | 3463 | ACCUUGUC CUGAUGAGGNNNNNNNNCCGAA AAGAUGGA | 7607 |
| 3251 | GACAAGGUC UACAGCAC | 3464 | GUGCUGUA CUGAUGAGGNNNNNNNNCCGAA ACCUUGUC | 7608 |
| 3253 | CAAGGUCUA CAGCACCA | 3465 | UGGUGCUG CUGAUGAGGNNNNNNNNCCGAA AGACCUUG | 7609 |
| 3277 | UGUGUGGUC CUAUGGCG | 3466 | CGCCAUAG CUGAUGAGGNNNNNNNNCCGAA ACCACACA | 7610 |
| 3280 | GUGGUCCUA UGGCGUGU | 3467 | ACACGCCA CUGAUGAGGNNNNNNNNCCGAA AGGACCAC | 7611 |
| 3289 | UGGCGUGUU GCUGUGGG | 3468 | CCCACAGC CUGAUGAGGNNNNNNNNCCGAA ACACGCCA | 7612 |
| 3302 | UGGGAGAUC UUCUCCUU | 3469 | AAGGAGAA CUGAUGAGGNNNNNNNNCCGAA AUCUCCCA | 7613 |
| 3304 | GGAGAUCUU CUCCUCAG | 3470 | CUAAGGAG CUGAUGAGGNNNNNNNNCCGAA AGAUCUCC | 7614 |
| 3305 | GAGAUCUUC UCCUUCAG | 3471 | CCUAAGGA CUGAUGAGGNNNNNNNNCCGAA AAGAUCUC | 7615 |
| 3307 | GAUCUCUCU CUUAGGGG | 3472 | CCCCUAAG CUGAUGAGGNNNNNNNNCCGAA AGAAGAUC | 7616 |
| 3310 | CUUCUCCUU AGGGGUU | 3473 | AACCCCCU CUGAUGAGGNNNNNNNNCCGAA AGGAGAAG | 7617 |
| 3311 | UUCUCCUUA GGGGUUC | 3474 | GAACCCCC CUGAUGAGGNNNNNNNNCCGAA AAGGAGAA | 7618 |
| 3318 | UAGGGGGUU CUCCAUAC | 3475 | GUAUGGAG CUGAUGAGGNNNNNNNNCCGAA ACCCCCUA | 7619 |
| 3319 | AGGGGGUUC UCCAUACC | 3476 | GGUAUGGA CUGAUGAGGNNNNNNNNCCGAA AACCCCCU | 7620 |
| 3321 | GGGGUUCUC CAUACCCA | 3477 | UGGGUAUG CUGAUGAGGNNNNNNNNCCGAA AGAACCCC | 7621 |
| 3325 | UUCUCCAUA CCCAGGAG | 3478 | CUCCUGGG CUGAUGAGGNNNNNNNNCCGAA AUGGAGAA | 7622 |
| 3352 | UGAAGACUU CUGUAGCC | 3479 | GGCUGCAG CUGAUGAGGNNNNNNNNCCGAA AGUCUUCA | 7623 |
| 3353 | GAAGACUUC UGCAGCCG | 3480 | CGGCUGCA CUGAUGAGGNNNNNNNNCCGAA AAGUCUUC | 7624 |
| 3397 | CCCGGAGUA UGCCACAC | 3481 | GUGUGGCA CUGAUGAGGNNNNNNNNCCGAA AGUCCGGG | 7625 |
| 3413 | CCUGAAAUC UACCAAAU | 3482 | AUUUGGUA CUGAUGAGGNNNNNNNNCCGAA AUUUCAGG | 7626 |
| 3415 | UGAAAUCUA CCAAAUCA | 3483 | UGAUUUGG CUGAUGAGGNNNNNNNNCCGAA AGAUUUCA | 7627 |
| 3422 | UACCAAAUC AUGUUGGA | 3484 | UCCAACAU CUGAUGAGGNNNNNNNNCCGAA AUUUGGUA | 7628 |
| 3427 | AAUCAUGUU GGAUUGCU | 3485 | AGCAAUCC CUGAUGAGGNNNNNNNNCCGAA AGAUGAUU | 7629 |
| 3432 | UGUUGGAUU GCUGGCAC | 3486 | GUGCCAGC CUGAUGAGGNNNNNNNNCCGAA AUCCAACA | 7630 |
| 3466 | GCCCCGGUU UGCUGAAC | 3487 | GUUCAGCA CUGAUGAGGNNNNNNNNCCGAA ACCGGGGC | 7631 |
| 3467 | CCCCGGUUU GCUGAACU | 3488 | AGUUCAGC CUGAUGAGGNNNNNNNNCCGAA AACCGGGG | 7632 |
| 3476 | GCUGAACUU GUGGAGAA | 3489 | UUCUCCAC CUGAUGAGGNNNNNNNNCCGAA ACUUCAGC | 7633 |
| 3488 | GAGAAACUU GGUGACCU | 3490 | AGGUCACC CUGAUGAGGNNNNNNNNCCGAA AGUUUCUC | 7634 |
| 3500 | GACCUGCUU CAAGCCAA | 3491 | UUGGCUUG CUGAUGAGGNNNNNNNNCCGAA AGCAGGUC | 7635 |
| 3501 | ACCUGCUUC AAGCCAAC | 3492 | GUUGGCUU CUGAUGAGGNNNNNNNNCCGAA AAGCAGGU | 7636 |
| 3512 | GCCAACGUC CAACAGGA | 3493 | UCCUGUUG CUGAUGAGGNNNNNNNNCCGAA ACGUUGGC | 7637 |
| 3531 | GGAAAGAUU ACAUCCCC | 3494 | GGGGAUGU CUGAUGAGGNNNNNNNNCCGAA AUCUUUCC | 7638 |
| 3532 | GAAAGAUUA CAUCCCCC | 3495 | GGGGGAUG CUGAUGAGGNNNNNNNNCCGAA AAUCUUUC | 7639 |
| 3536 | GAUUACAUC CCCCUCAA | 3496 | UUGAGGGG CUGAUGAGGNNNNNNNNCCGAA AUGUAAUC | 7640 |
| 3542 | AUCCCCCUC AAUGCCAU | 3497 | AUGGCAUU CUGAUGAGGNNNNNNNNCCGAA AGGGGGAU | 7641 |
| 3551 | AAUGCCAUA CUGACUAG | 3498 | CUAGUCAG CUGAUGAGGNNNNNNNNCCGAA AUGGCAUU | 7642 |
| 3558 | UACAGACUA GAAACAGU | 3499 | ACUGUUUC CUGAUGAGGNNNNNNNNCCGAA AGUCAGUA | 7643 |
| 3567 | GAAACAGUA GCUUCACA | 3500 | UGUGAAGC CUGAUGAGGNNNNNNNNCCGAA ACUGUUUC | 7644 |
| 3571 | CAGUAGCUU CACAUACU | 3501 | AGUAUGUG CUGAUGAGGNNNNNNNNCCGAA AGCUACUG | 7645 |
| 3572 | AGUAGCUUC ACAUACUC | 3502 | GAGUAUGU CUGAUGAGGNNNNNNNNCCGAA AAGCUACU | 7646 |
| 3577 | CUUCACAUA CUCGACCC | 3503 | GGGUCGAG CUGAUGAGGNNNNNNNNCCGAA AUGUGAAG | 7647 |
| 3580 | CACAUACUC GACCCCA | 3504 | UGGGGGUC CUGAUGAGGNNNNNNNNCCGAA AGUCUGUG | 7648 |
| 3592 | CCCCACCUU CUCUGAGG | 3505 | CCUCAGAG CUGAUGAGGNNNNNNNNCCGAA AGGUGGGG | 7649 |
| 3593 | CCCACCUUC UCUGAGGA | 3506 | UCCUCAGA CUGAUGAGGNNNNNNNNCCGAA AAGGUGGG | 7650 |
| 3595 | CACCUUCUC UGAGGACC | 3507 | GGUCCUCA CUGAUGAGGNNNNNNNNCCGAA AGAAGGUG | 7651 |
| 3605 | GAGGACCUU UUCAAGGA | 3508 | UCCUUGAA CUGAUGAGGNNNNNNNNCCGAA AGGUCCUC | 7652 |
| 3606 | AGGACCUUU UCAAGGAC | 3509 | GUCCUUGA CUGAUGAGGNNNNNNNNCCGAA AAGGUCCU | 7653 |
| 3607 | GGACCUUUU CAAGGACG | 3510 | CGUCCUUG CUGAUGAGGNNNNNNNNCCGAA AAAGGUCC | 7654 |
| 3608 | GACCUUUUC AAGGACGG | 3511 | CCGUCCUU CUGAUGAGGNNNNNNNNCCGAA AAAAGGUC | 7655 |
| 3619 | GGACGGCUU UGCAGAUC | 3512 | GAUCUGCA CUGAUGAGGNNNNNNNNCCGAA AGCCGUCC | 7656 |
| 3620 | GACGGCUUU GCAGAUCC | 3513 | GGAUCUGC CUGAUGAGGNNNNNNNNCCGAA AAGCCGUC | 7657 |
| 3627 | UUGCAGAUC CACAUUUU | 3514 | AAAAUGUG CUGAUGAGGNNNNNNNNCCGAA AUCUGCAA | 7658 |
| 3633 | AUCCACAUU UUCAUUCC | 3515 | GGAAUGAA CUGAUGAGGNNNNNNNNCCGAA AUGUGGAU | 7659 |
| 3634 | UCCACAUUU UCAUUCCG | 3516 | CGGAAUGA CUGAUGAGGNNNNNNNNCCGAA AAUGUGGA | 7660 |
| 3635 | CCACAUUUU CAUUCCGG | 3517 | CCGGAAUG CUGAUGAGGNNNNNNNNCCGAA AAAUGUGG | 7661 |
| 3636 | CACAUUUUC AUUCCGGA | 3518 | UCCGGAAU CUGAUGAGGNNNNNNNNCCGAA AAAAUGUG | 7662 |
| 3639 | AUUUUCAUU CCGGAAGC | 3519 | GCUUCCGG CUGAUGAGGNNNNNNNNCCGAA AUGAAAAU | 7663 |
| 3640 | UUUUCAUUC CGGAAGCU | 3520 | AGCUUCCG CUGAUGAGGNNNNNNNNCCGAA AAUGAAAA | 7664 |
| 3649 | CGGAAGCUC UGAUGAUG | 3521 | CAUCAUCA CUGAUGAGGNNNNNNNNCCGAA AGCUUCCG | 7665 |
| 3664 | UGUGAGAUA UGUAAACG | 3522 | CGUUUACA CUGAUGAGGNNNNNNNNCCGAA AUCUCACA | 7666 |
| 3668 | AGAUAUGUA AACGCUUU | 3523 | AAAGCGUU CUGAUGAGGNNNNNNNNCCGAA ACAUAUCU | 7667 |
| 3675 | UAAACGCUU UCAAAUUC | 3524 | GAAUUUGA CUGAUGAGGNNNNNNNNCCGAA AGCGUUUA | 7668 |
| 3676 | AAACGCUUU CAAAUUCA | 3525 | UGAAUUUG CUGAUGAGGNNNNNNNNCCGAA AAGCGUUU | 7669 |

TABLE VIII-continued

Mouse *flt*-1 VEGF Receptor-Hammerhead Ribozyme and Substrate Sequence

| Pos | Substrate | Seq ID No | HH Ribozyme Sequence | Seq ID No |
|---|---|---|---|---|
| 3677 | AACGCUUUC AAAUUCAU | 3526 | AUGAAUUU CUGAUGAGGNNNNNNNNCCGAA AAAGCGUU | 7670 |
| 3682 | UUUCAAAUU CAUGAGCC | 3527 | GGCUCAUG CUGAUGAGGNNNNNNNNCCGAA AUUUGAAA | 7671 |
| 3683 | UUCAAAUUC AUGAGCCU | 3528 | AGGCUCAU CUGAUGAGGNNNNNNNNCCGAA AAUUUGAA | 7672 |
| 3701 | GAAAGAAUC AAAACCUU | 637 | AAGGUUUU CUGAUGAGGNNNNNNNNCCGAA AUUCUUUC | 4793 |
| 3709 | CAAAACCUU UGAGGAGC | 3529 | GCUCCUCA CUGAUGAGGNNNNNNNNCCGAA AGGUUUUG | 7673 |
| 3710 | AAAACCUUU GAGGAGCU | 3530 | AGCUCCUC CUGAUGAGGNNNNNNNNCCGAA AAGGUUUU | 7674 |
| 3719 | GAGGAGCUU UCACCGAA | 3531 | UUCGGUGA CUGAUGAGGNNNNNNNNCCGAA AGCUCCUC | 7675 |
| 3720 | AGGAGCUUU CACCGAAC | 3532 | GUUCGGUG CUGAUGAGGNNNNNNNNCCGAA AAGCUCCU | 7676 |
| 3721 | GGAGCUUUC ACCGAACU | 3533 | AGUUCGGU CUGAUGAGGNNNNNNNNCCGAA AAAGCUCC | 7677 |
| 3730 | ACCGAACUC CACCUCCA | 3534 | UGGAGGUG CUGAUGAGGNNNNNNNNCCGAA AGUUCGGU | 7678 |
| 3736 | CUCCACCUC CAUGUUUG | 3535 | CAAACAUG CUGAUGAGGNNNNNNNNCCGAA AGGUGGAG | 7679 |
| 3742 | CUCCAUGUU UGAGGACU | 3536 | AGUCCUCA CUGAUGAGGNNNNNNNNCCGAA ACAUGGAG | 7680 |
| 3743 | UCCAUGUUU GAGGACUA | 3537 | UAGUCCUC CUGAUGAGGNNNNNNNNCCGAA AACAUGGA | 7681 |
| 3751 | UGAGGACUA UCAGCUGG | 3538 | CCAGCUGA CUGAUGAGGNNNNNNNNCCGAA AGUCCUCA | 7682 |
| 3753 | AGGACUAUC AGCUGGAC | 3539 | GUCCAGCU CUGAUGAGGNNNNNNNNCCGAA AUAGUCCU | 7683 |
| 3765 | UGGACACUA GCACUCUG | 3540 | CAGAGUGC CUGAUGAGGNNNNNNNNCCGAA AGUGUCCA | 7684 |
| 3771 | CUAGCACUC UGCUGGGC | 3541 | GCCCAGCA CUGAUGAGGNNNNNNNNCCGAA AGUGCUAG | 7685 |
| 3781 | GCUGGGCUC CCCCUUGC | 3542 | GCAAGGGG CUGAUGAGGNNNNNNNNCCGAA AGCCCAGC | 7686 |
| 3787 | CUCCCCCUU GCUGAAGC | 3543 | GCUUCAGC CUGAUGAGGNNNNNNNNCCGAA AGGGGGAG | 7687 |
| 3799 | GAAGCGGUU CACCUGGA | 3544 | UCCAGGUG CUGAUGAGGNNNNNNNNCCGAA ACCGCUUC | 7688 |
| 3800 | AAGCGGUUC ACCUGGAC | 3545 | GUCCAGGU CUGAUGAGGNNNNNNNNCCGAA AACCGCUU | 7689 |
| 3829 | CAAGGCCUC CAUGAAGA | 3546 | UCUUCAUG CUGAUGAGGNNNNNNNNCCGAA AGGCCUUG | 7690 |
| 3839 | AUGAAGAUA GACUUGAG | 3547 | CUCAAGUC CUGAUGAGGNNNNNNNNCCGAA AUCUUCAU | 7691 |
| 3844 | GAUAGACUU GAGAAUAG | 3548 | CUAUUCUC CUGAUGAGGNNNNNNNNCCGAA AGUCUAUC | 7692 |
| 3851 | UUGAGAAUA GCGAGUAA | 3549 | UUACUCGC CUGAUGAGGNNNNNNNNCCGAA AUUCUCAA | 7693 |
| 3858 | UAGCGAGUA AAAGCAAG | 3550 | CUUGCUUU CUGAUGAGGNNNNNNNNCCGAA ACUCGCUA | 7694 |
| 3878 | GCGGGACUU UCCGAUCU | 3551 | AGAUCGGA CUGAUGAGGNNNNNNNNCCGAA AGUCCCGC | 7695 |
| 3879 | CGGGACUUU CCGAUCUG | 3552 | CAGAUCGG CUGAUGAGGNNNNNNNNCCGAA AAGUCCCG | 7696 |
| 3880 | GGGACUUUC CGAUCUGC | 3553 | GCAGAUCG CUGAUGAGGNNNNNNNNCCGAA AAAGUCCC | 7697 |
| 3885 | UUUCCGAUC UGCCGAGG | 3554 | CCUCGGCA CUGAUGAGGNNNNNNNNCCGAA AUCGGAAA | 7698 |
| 3901 | GCCCAGCUU CUGCUUCU | 3555 | AGAAGCAG CUGAUGAGGNNNNNNNNCCGAA AGCUGGGC | 7699 |
| 3902 | CCCAGCUUC UGCUUCUC | 3556 | GAGAAGCA CUGAUGAGGNNNNNNNNCCGAA AAGCUGGG | 7700 |
| 3907 | CUUCUGCUU CUCCAGCU | 3557 | AGCUGGAG CUGAUGAGGNNNNNNNNCCGAA AGCAGAAG | 7701 |
| 3908 | UUCUGCUUC UCCAGCUG | 3558 | CAGCUGGA CUGAUGAGGNNNNNNNNCCGAA AAGCAGAA | 7702 |
| 3910 | CUGCUUCUC CAGCUGUG | 3559 | CACAGCUG CUGAUGAGGNNNNNNNNCCGAA AGAAGCAG | 7703 |
| 3926 | GGCCACAUC AGGCCCGU | 3560 | ACGGGCCU CUGAUGAGGNNNNNNNNCCGAA AUGUGGCC | 7704 |
| 3949 | CGAUGAAUC UGAGCUGG | 3561 | CCAGCUCA CUGAUGAGGNNNNNNNNCCGAA AUUCAUCG | 7705 |
| 3967 | AAAGGAGUC CUGCUGUU | 3562 | AACAGCAG CUGAUGAGGNNNNNNNNCCGAA ACUCCUUU | 7706 |
| 3975 | CCUGCUGUU CUCCACCC | 3563 | GGGUGGAG CUGAUGAGGNNNNNNNNCCGAA ACAGCAGG | 7707 |
| 3976 | CUGCUGUUC UCCACCCC | 3564 | GGGGUGGA CUGAUGAGGNNNNNNNNCCGAA AACAGCAG | 7708 |
| 3978 | GCUGUUCUC CACCCCCA | 3565 | UGGGGGUG CUGAUGAGGNNNNNNNNCCGAA AGAACAGC | 7709 |
| 3991 | CCCAGACUA CAACUCCG | 3566 | CGGAGUUG CUGAUGAGGNNNNNNNNCCGAA AGUCUGGG | 7710 |
| 3997 | CUACAACUC CGUGGUGU | 3567 | ACACCACG CUGAUGAGGNNNNNNNNCCGAA AGUUGUAG | 7711 |
| 4006 | CGUGGUGUU GUACUCCU | 3568 | AGGAGUAC CUGAUGAGGNNNNNNNNCCGAA ACACCACG | 7712 |
| 4009 | GGUGUUGUA CUCCUCCC | 3569 | GGGAGGAG CUGAUGAGGNNNNNNNNCCGAA ACAACACC | 7713 |
| 4012 | GUUGUACUC CUCCCCGC | 3570 | GCGGGGAG CUGAUGAGGNNNNNNNNCCGAA AGUACAAC | 7714 |
| 4015 | GUACUCCUC CCCGCCCG | 3571 | CGGGCGGG CUGAUGAGGNNNNNNNNCCGAA AGGAGUAC | 7715 |
| 4027 | GCCCGCCUA AAGCUUCU | 3572 | AGAAGCUU CUGAUGAGGNNNNNNNNCCGAA AGGCGGGC | 7716 |
| 4033 | CUAAAGCUU CUCACCAG | 3573 | CUGGUGAG CUGAUGAGGNNNNNNNNCCGAA AGCUUUAG | 7717 |
| 4034 | UAAAGCUUC UCACCAGC | 3574 | GCUGGUGA CUGAUGAGGNNNNNNNNCCGAA AAGCUUUA | 7718 |
| 4036 | AAGCUUCUC ACCAGCCC | 3575 | GGGCUGGU CUGAUGAGGNNNNNNNNCCGAA AGAAGCUU | 7719 |
| 4066 | CUGACAGUA UUAUACAU | 3576 | AUGUAUAA CUGAUGAGGNNNNNNNNCCGAA ACUGUCAG | 7720 |
| 4068 | GACAGUAUU AUACAUCU | 3577 | AGAUGUAU CUGAUGAGGNNNNNNNNCCGAA AUACUGUC | 7721 |
| 4069 | ACAGUAUUA UACAUCUA | 3578 | UAGAUGUA CUGAUGAGGNNNNNNNNCCGAA AAUACUGU | 7722 |
| 4071 | AGUAUUAUA CAUCUAUG | 3579 | CAUAGAUG CUGAUGAGGNNNNNNNNCCGAA AUAAUACU | 7723 |
| 4075 | UUAUACAUC UAUGAGUU | 3580 | AACUCAUA CUGAUGAGGNNNNNNNNCCGAA AUGUAUAA | 7724 |
| 4077 | AUACAUCUA UGAGUUUA | 3581 | UAAACUCA CUGAUGAGGNNNNNNNNCCGAA AGAUGUAU | 7725 |
| 4083 | CUAUGAGUU UACACCUA | 3582 | UAGGUGUA CUGAUGAGGNNNNNNNNCCGAA ACUCAUAG | 7726 |
| 4084 | UAUGAGUUU ACACCUAU | 3583 | AUAGGUGU CUGAUGAGGNNNNNNNNCCGAA AACUCAUA | 7727 |
| 4085 | AUGAGUUUA CACCUAUU | 3584 | AAUAGGUG CUGAUGAGGNNNNNNNNCCGAA AAACUCAU | 7728 |
| 4091 | UUACACCUA UUCCGCUC | 3585 | GAGCGGAA CUGAUGAGGNNNNNNNNCCGAA AGGUGUAA | 7729 |
| 4093 | ACACCUAUU CCGCUCCA | 3586 | UGGAGCGG CUGAUGAGGNNNNNNNNCCGAA AUAGGUGU | 7730 |
| 4094 | CACCUAUUC CGCUCCAC | 3587 | GUGGAGCG CUGAUGAGGNNNNNNNNCCGAA AAUAGGUG | 7731 |
| 4099 | AUUCCGCUC CACAGGAG | 3588 | CUCCUGUG CUGAUGAGGNNNNNNNNCCGAA AGCGGAAU | 7732 |
| 4117 | CAGCUGCUU UUCGUGAC | 3589 | GUCACGAA CUGAUGAGGNNNNNNNNCCGAA AGCAGCUG | 7733 |
| 4118 | AGCUGCUUU UCGUGACC | 3590 | GGUCACGA CUGAUGAGGNNNNNNNNCCGAA AAGCAGCU | 7734 |
| 4119 | GCUGCUUUU CGUGACCU | 3591 | AGGUCACG CUGAUGAGGNNNNNNNNCCGAA AAAGCAGC | 7735 |
| 4120 | CUGCUUUUC GUGACCUU | 3592 | AAGGUCAC CUGAUGAGGNNNNNNNNCCGAA AAAAGCAG | 7736 |
| 4128 | CGUGACCUU UAAUCGUG | 3593 | CACGAUUA CUGAUGAGGNNNNNNNNCCGAA AGGUCACG | 7737 |
| 4129 | GUGACCUUU AAUCGUGC | 3594 | GCACGAUU CUGAUGAGGNNNNNNNNCCGAA AAGGUCAC | 7738 |
| 4130 | UGACCUUUA AUCGUGCU | 3595 | AGCACGAU CUGAUGAGGNNNNNNNNCCGAA AAAGGUCA | 7739 |
| 4133 | CCUUUAAUC GUGCUUUU | 3596 | AAAAGCAC CUGAUGAGGNNNNNNNNCCGAA AUUAAAGG | 7740 |
| 4139 | AUCGUGCUU UUUGUUU | 3597 | AAACAAAA CUGAUGAGGNNNNNNNNCCGAA AGCACGAU | 7741 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4140 | UCGUGCUUU UUUGUUUU | 3598 | AAAACAAA CUGAUGAGGNNNNNNNNCCGAA AAGCACGA | 7742 |
| 4141 | CGUGCUUUU UUGUUUUU | 3599 | AAAAACAA CUGAUGAGGNNNNNNNNCCGAA AAGCACG | 7743 |
| 4142 | GUGCUUUUU UGUUUUUU | 3600 | AAAAAACA CUGAUGAGGNNNNNNNNCCGAA AAAAGCAC | 7744 |
| 4143 | UGCUUUUUU GUUUUUUG | 3601 | CAAAAAAC CUGAUGAGGNNNNNNNNCCGAA AAAAAGCA | 7745 |
| 4146 | UUUUUUGUU UUUUGUUU | 3602 | AAACAAAA CUGAUGAGGNNNNNNNNCCGAA ACAAAAAA | 7746 |
| 4147 | UUUUUGUUU UUUGUUUU | 3603 | AAAACAAA CUGAUGAGGNNNNNNNNCCGAA AACAAAAA | 7747 |
| 4148 | UUUUGUUUU UUGUUUUG | 3604 | CAAAACAA CUGAUGAGGNNNNNNNNCCGAA AAACAAAA | 7748 |
| 4149 | UUUGUUUUU UGUUUUGU | 3605 | ACAAAACA CUGAUGAGGNNNNNNNNCCGAA AAACAAA | 7749 |
| 4150 | UUGUUUUUU GUUUUGUU | 3606 | AACAAAAC CUGAUGAGGNNNNNNNNCCGAA AAAAACAA | 7750 |
| 4153 | UUUUUUGUU UUUGUUUGU | 3607 | ACAAACAA CUGAUGAGGNNNNNNNNCCGAA ACAAAAAA | 7751 |
| 4154 | UUUUUGUUU UGUUUGUU | 3608 | AACAAACA CUGAUGAGGNNNNNNNNCCGAA AACAAAAA | 7752 |
| 4155 | UUUUGUUUU GUUUGUUG | 3609 | CAACAAAC CUGAUGAGGNNNNNNNNCCGAA AAACAAAA | 7753 |
| 4158 | UGUUUGUU UGUUGUUG | 3610 | CAACAACA CUGAUGAGGNNNNNNNNCCGAA ACAAACA | 7754 |
| 4159 | GUUUUGUU GUUGUUGC | 3611 | GCAACAAC CUGAUGAGGNNNNNNNNCCGAA AACAAAAC | 7755 |
| 4162 | UUGCUUGUU GUUGCUGU | 3612 | ACAGCAAC CUGAUGAGGNNNNNNNNCCGAA ACAAACAA | 7756 |
| 4165 | UUUGUUGUU GCUGUUUU | 3613 | AAAACAGC CUGAUGAGGNNNNNNNNCCGAA ACAACAAA | 7757 |
| 4171 | GUUGCUGUU UUGACUAA | 3614 | UUAGUCAA CUGAUGAGGNNNNNNNNCCGAA ACAGCAAC | 7758 |
| 4172 | UUGCUGUUU UGACUAAC | 3615 | GUUAGUCA CUGAUGAGGNNNNNNNNCCGAA AACAGCAA | 7759 |
| 4173 | UGCUGUUUU GACUAACA | 3616 | UGUUAGUC CUGAUGAGGNNNNNNNNCCGAA AAACAGCA | 7760 |
| 4178 | UUUUGACUA ACAAGAAU | 737 | AUUCUUGU CUGAUGAGGNNNNNNNNCCGAA AGUCAAAA | 4893 |
| 4189 | AAGAAUGUA ACCCCAGU | 3617 | ACUGGGGU CUGAUGAGGNNNNNNNNCCGAA ACAUUCUU | 7761 |
| 4198 | ACCCCAGUU AGUGACGU | 3618 | ACGUCACU CUGAUGAGGNNNNNNNNCCGAA ACUGGGGU | 7762 |
| 4199 | CCCCAGUUA GUGACGUG | 3619 | CACGUCAC CUGAUGAGGNNNNNNNNCCGAA AACUGGGG | 7763 |
| 4216 | UGAAGAAUA CUAUUGUU | 3620 | AACAAUAG CUGAUGAGGNNNNNNNNCCGAA AUUCUUCA | 7764 |
| 4219 | AGAAUACUA UUGUUAGA | 3621 | UCUAACAA CUGAUGAGGNNNNNNNNCCGAA AGUAUUCU | 7765 |
| 4221 | AAUACUAUU GUUAGAGA | 3622 | UCUCUAAC CUGAUGAGGNNNNNNNNCCGAA AUAGUAUU | 7766 |
| 4224 | ACUAUUGUU AGAGAAAU | 3623 | AUUUCUCU CUGAUGAGGNNNNNNNNCCGAA ACAAUAGU | 7767 |
| 4225 | CUAUUGUUA GAGAAAUC | 3624 | GAUUUCUC CUGAUGAGGNNNNNNNNCCGAA AACAAUAG | 7768 |
| 4233 | AGAGAAAUC CCCCCGC | 3625 | GCGGGGGG CUGAUGAGGNNNNNNNNCCGAA AUUUCUCU | 7769 |
| 4249 | CAAAGCCUC AGGGUAAC | 3626 | GUUACCCU CUGAUGAGGNNNNNNNNCCGAA AGGCUUUG | 7770 |
| 4255 | CUCAGGGUA ACCUGGAC | 3627 | GUCCAGGU CUGAUGAGGNNNNNNNNCCGAA ACCCUGAG | 7771 |
| 4282 | AGGUGCCUC UGGCGACC | 3628 | GGUCGCCA CUGAUGAGGNNNNNNNNCCGAA AGGCACCU | 7772 |
| 4323 | CCCACCCUC CCUGCAGC | 3629 | GCUGCAGG CUGAUGAGGNNNNNNNNCCGAA AGGGUGGG | 7773 |
| 4341 | GUGGGACUA GAGGCAGU | 3630 | ACUGCCUC CUGAUGAGGNNNNNNNNCCGAA AGUCCCAC | 7774 |
| 4350 | GAGGCAGUA AGCCCAUU | 3631 | AAUGGGCU CUGAUGAGGNNNNNNNNCCGAA ACUGCCUC | 7775 |
| 4358 | AAGCCCAUU AGCUCAUG | 3632 | CAUGAGCU CUGAUGAGGNNNNNNNNCCGAA AUGGGCUU | 7776 |
| 4359 | AGCCCAUUA GCUCAUGG | 3633 | CCAUGAGC CUGAUGAGGNNNNNNNNCCGAA AAUGGGCU | 7777 |
| 4363 | CAUUAGCUC AUGGCUGC | 3634 | GCAGCCAU CUGAUGAGGNNNNNNNNCCGAA AGCUAAUG | 7778 |
| 4387 | GACCUGCUC UGUCUCUC | 3635 | GAGAGACA CUGAUGAGGNNNNNNNNCCGAA AGCAGGUC | 7779 |
| 4391 | UGCUCUGUC UCUCUUAU | 3636 | AUAAGAGA CUGAUGAGGNNNNNNNNCCGAA ACAGAGCA | 7780 |
| 4393 | CUCUGUCUC UCUUAUGG | 3637 | CCAUAAGA CUGAUGAGGNNNNNNNNCCGAA AGACAGAG | 7781 |
| 4395 | CUGUCUCUC UUAUGGAG | 3638 | CUCCAUAA CUGAUGAGGNNNNNNNNCCGAA AGAGACAG | 7782 |
| 4397 | GUCUCUCUU AUGGAGGA | 3639 | UCCUCCAU CUGAUGAGGNNNNNNNNCCGAA AGAGAGAC | 7783 |
| 4398 | UCUCUCUUA UGGAGGAA | 3640 | UUCCUCCA CUGAUGAGGNNNNNNNNCCGAA AAGAGAGA | 7784 |
| 4445 | AAAAGGCUU UGGGAUGC | 3641 | GCAUCCCA CUGAUGAGGNNNNNNNNCCGAA AGCCUUUU | 7785 |
| 4446 | AAAGGCUUU GGGAUGCG | 3642 | CGCAUCCC CUGAUGAGGNNNNNNNNCCGAA AAGCCUUU | 7786 |
| 4456 | GGAUGCGUC CGUCCUGU | 3643 | ACAGGACG CUGAUGAGGNNNNNNNNCCGAA ACGCAUCC | 7787 |
| 4460 | GCGUCCGUC CUGUGGAG | 3644 | CUCCACAG CUGAUGAGGNNNNNNNNCCGAA ACGGACGC | 7788 |
| 4487 | AGGGGGCUC CGCUAUGC | 3645 | GCAUAGCG CUGAUGAGGNNNNNNNNCCGAA AGCCCCCU | 7789 |
| 4492 | GCUCCGCUA UGCCACUU | 3646 | AAGUGGCA CUGAUGAGGNNNNNNNNCCGAA AGCGGAGC | 7790 |
| 4500 | AUGCCACUU CAGUGACU | 3647 | AGUCACUG CUGAUGAGGNNNNNNNNCCGAA AGUGGCAU | 7791 |
| 4501 | UGCCACUUC AGUGACUU | 3648 | AAGUCACU CUGAUGAGGNNNNNNNNCCGAA AAGUGGCA | 7792 |
| 4509 | CAGUGACUU CUCACUCC | 3649 | GGAGUGAG CUGAUGAGGNNNNNNNNCCGAA AGUCACUG | 7793 |
| 4510 | AGUGACUUC UCACUCCU | 3650 | AGGAGUGA CUGAUGAGGNNNNNNNNCCGAA AAGUCACU | 7794 |
| 4512 | UGACUUCUC ACUCCUGG | 3651 | CCAGGAGU CUGAUGAGGNNNNNNNNCCGAA AGAAGUCA | 7795 |
| 4516 | UUCUCACUC CUGGCCUC | 3652 | GAGGCCAG CUGAUGAGGNNNNNNNNCCGAA AGUGAGAA | 7796 |
| 4524 | CCUGGCCUC CGCUGUUU | 3653 | AAACAGCG CUGAUGAGGNNNNNNNNCCGAA AGGCCAGG | 7797 |
| 4531 | UCCGCUGUU UCGGGCCC | 3654 | GGGCCCGA CUGAUGAGGNNNNNNNNCCGAA ACAGCGGA | 7798 |
| 4532 | CCGCUGUUU CGGGCCCC | 3655 | GGGGCCCG CUGAUGAGGNNNNNNNNCCGAA AACAGCGG | 7799 |
| 4533 | CGCUGUUUC GGGCCCCG | 3656 | GGGGGCCC CUGAUGAGGNNNNNNNNCCGAA AAACAGCG | 7800 |
| 4543 | GGCCCCCUU CCAAGAGG | 3657 | CCUCUUGG CUGAUGAGGNNNNNNNNCCGAA AGGGGGCC | 7801 |
| 4544 | GCCCCCUUC CAAGAGGU | 3658 | ACCUCUUG CUGAUGAGGNNNNNNNNCCGAA AAGGGGGC | 7802 |
| 4553 | CAAGAGGUA UCAGAGCA | 3659 | UGCUCUGA CUGAUGAGGNNNNNNNNCCGAA ACCUCUUG | 7803 |
| 4555 | AGAGGUAUC AGAGCAGA | 3660 | UCUGCUCU CUGAUGAGGNNNNNNNNCCGAA AUACCUCU | 7804 |
| 4577 | AGGGACGUU UCCUAGAC | 3661 | GUCUAGGA CUGAUGAGGNNNNNNNNCCGAA ACGUCCCU | 7805 |
| 4578 | GGGACGUUU CCUAGACC | 3662 | GGUCUAGG CUGAUGAGGNNNNNNNNCCGAA AACGUCCC | 7806 |
| 4579 | GGACGUUUC CUAGACCA | 3663 | UGGUCUAG CUGAUGAGGNNNNNNNNCCGAA AAACGUCC | 7807 |
| 4582 | CGUUUCCUA GACCAGGG | 3664 | CCCUGGUC CUGAUGAGGNNNNNNNNCCGAA AGGAAACG | 7808 |
| 4598 | GCACAUGUU CUCGGGAA | 3665 | UUCCCGAG CUGAUGAGGNNNNNNNNCCGAA ACAUGUGC | 7809 |
| 4599 | CACAUGUUC UCGGGAAC | 3666 | GUUCCCGA CUGAUGAGGNNNNNNNNCCGAA AACAUGUG | 7810 |
| 4601 | CAUGUUCUC GGGAACCA | 3667 | UGGUUCCC CUGAUGAGGNNNNNNNNCCGAA AGAACAUG | 7811 |
| 4614 | ACCACAGUU AAUCUUAA | 3668 | UUAAGAUU CUGAUGAGGNNNNNNNNCCGAA ACUGUGGU | 7812 |
| 4615 | CCACAGUUA AUCUUAAA | 3669 | UUUAAGAU CUGAUGAGGNNNNNNNNCCGAA AACUGUGG | 7813 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 4618 | CAGUUAAUC UUAAAUCU | 3670 | AGAUUUAA CUGAUGAGGNNNNNNNNCCGAA AUUAACUG | 7814 |
| 4620 | GUUAAUCUU AAAUCUUU | 3671 | AAAGAUUU CUGAUGAGGNNNNNNNNCCGAA AGAUUAAC | 7815 |
| 4621 | UUAAUCUUA AAUCUUUU | 3672 | AAAAGAUU CUGAUGAGGNNNNNNNNCCGAA AAGAUUAA | 7816 |
| 4625 | UCUUAAAUC UUUUCCCG | 3673 | CGGGAAAA CUGAUGAGGNNNNNNNNCCGAA AUUUAAGA | 7817 |
| 4627 | UUAAAUCUU UUCCCGGG | 3674 | CCCGGGAA CUGAUGAGGNNNNNNNNCCGAA AGAUUUAA | 7818 |
| 4628 | UAAAUCUUU UCCCGGGA | 3675 | UCCCGGGA CUGAUGAGGNNNNNNNNCCGAA AAGAUUUA | 7819 |
| 4629 | AAAUCUUUU CCCGGGAG | 3676 | CUCCCGGG CUGAUGAGGNNNNNNNNCCGAA AAAGAUUU | 7820 |
| 4630 | AAUCUUUUC CCGGGAGU | 3677 | ACUCCCGG CUGAUGAGGNNNNNNNNCCGAA AAAAGAUU | 7821 |
| 4639 | CCGGGAGUC UUCUGUUG | 3678 | CAACAGAA CUGAUGAGGNNNNNNNNCCGAA ACUCCCGG | 7822 |
| 4641 | GGGAGUCUU CUGUUGUC | 3679 | GACAACAG CUGAUGAGGNNNNNNNNCCGAA AGACUCCC | 7823 |
| 4642 | GGAGUCUUC UGUUGUCU | 3680 | AGACAACA CUGAUGAGGNNNNNNNNCCGAA AAGACUCC | 7824 |
| 4646 | UCUUCUGUU GUCUGUUU | 3681 | AAACAGAC CUGAUGAGGNNNNNNNNCCGAA ACAGAAGA | 7825 |
| 4649 | UCUGUUGUC UGUUUACC | 3682 | GGUAAACA CUGAUGAGGNNNNNNNNCCGAA ACAACAGA | 7826 |
| 4653 | UUGUCUGUU UACCAUCC | 3683 | GGAUGGUA CUGAUGAGGNNNNNNNNCCGAA ACAGACAA | 7827 |
| 4654 | UGUCUGUUU ACCAUCCA | 3684 | UGGAUGGU CUGAUGAGGNNNNNNNNCCGAA AACAGACA | 7828 |
| 4655 | GUCUGUUUA CCAUCCAA | 3685 | UUGGAUGG CUGAUGAGGNNNNNNNNCCGAA AAACAGAC | 7829 |
| 4660 | UUUACCAUC CAAAGCAU | 3686 | AUGCUUUG CUGAUGAGGNNNNNNNNCCGAA AUGGUAAA | 7830 |
| 4669 | CAAAGCAUA UUUAACAU | 3687 | AUGUUAAA CUGAUGAGGNNNNNNNNCCGAA AUGCUUUG | 7831 |
| 4671 | AAGCAUAUU UAACAUGU | 3688 | ACAUGUUA CUGAUGAGGNNNNNNNNCCGAA AUAUGCUU | 7832 |
| 4672 | AGCAUAUUU AACAUGUG | 3689 | CACAUGUU CUGAUGAGGNNNNNNNNCCGAA AAUAUGCU | 7833 |
| 4673 | GCAUAUUUA ACAUGUGU | 3690 | ACACAUGU CUGAUGAGGNNNNNNNNCCGAA AAAUAUGC | 7834 |
| 4682 | ACAUGUGUC AGUGGGGG | 3691 | CCCCCACU CUGAUGAGGNNNNNNNNCCGAA ACACAUGU | 7835 |
| 4698 | GUGGCGCUU GGCUUCUG | 3692 | CAGAAGCC CUGAUGAGGNNNNNNNNCCGAA AGCGCCAC | 7836 |
| 4703 | GCUUGGCUU CUGAGGCC | 3693 | GGCCUCAG CUGAUGAGGNNNNNNNNCCGAA AGCCAAGC | 7837 |
| 4704 | CUUGGCUUC UGAGGCCA | 3694 | UGGCCUCA CUGAUGAGGNNNNNNNNCCGAA AAGCCAAG | 7838 |
| 4720 | AGAGCCAUC AUCAGUUC | 3695 | GAACUGAU CUGAUGAGGNNNNNNNNCCGAA AUGGCUCU | 7839 |
| 4723 | GCCAUCAUC AGUUCCUC | 3696 | GAGGAACU CUGAUGAGGNNNNNNNNCCGAA AUGAUGGC | 7840 |
| 4727 | UCAUCAGUU CCUCUAGU | 3697 | ACUAGAGG CUGAUGAGGNNNNNNNNCCGAA ACUGAUGA | 7841 |
| 4728 | CAUCAGUUC CUCUAGUG | 3698 | CACUAGAG CUGAUGAGGNNNNNNNNCCGAA AACUGAUG | 7842 |
| 4731 | CAGUUCCUC UAGUGAGA | 3699 | UCUCACUA CUGAUGAGGNNNNNNNNCCGAA AGGAACUG | 7843 |
| 4733 | GUUCCUCUA GUGAGAUG | 3700 | CAUCUCAC CUGAUGAGGNNNNNNNNCCGAA AGAGGAAC | 7844 |
| 4745 | AGAUGCAUU GAGGUCAU | 3701 | AUGACCUC CUGAUGAGGNNNNNNNNCCGAA AUGCAUCU | 7845 |
| 4751 | AUUGAGGUC AUACCCAA | 3702 | UUGGGUAU CUGAUGAGGNNNNNNNNCCGAA ACCUCAAU | 7846 |
| 4754 | GAGGUCAUA CCCAAGCU | 3703 | AGCUUGGG CUGAUGAGGNNNNNNNNCCGAA AUGACCUC | 7847 |
| 4763 | CCCAAGCUU GCAGGCCU | 3704 | AGGCCUGC CUGAUGAGGNNNNNNNNCCGAA AGCUUGGG | 7848 |
| 4777 | CCUGACCUU CGCAUACU | 3705 | AGUAUGCG CUGAUGAGGNNNNNNNNCCGAA AGGUCAGG | 7849 |
| 4778 | CUGACCUUC GCAUACUG | 3706 | CAGUAUGC CUGAUGAGGNNNNNNNNCCGAA AAGGUCAG | 7850 |
| 4783 | CUUCGCAUA CUGCUCAC | 3707 | GUGAGCAG CUGAUGAGGNNNNNNNNCCGAA AUGCGAAG | 7851 |
| 4789 | AUACUGCUC ACGGGGAG | 3708 | CUCCCCGU CUGAUGAGGNNNNNNNNCCGAA AGCAGUAU | 7852 |
| 4799 | CGGGGAGUU AAGUGGUC | 3709 | GACCACUU CUGAUGAGGNNNNNNNNCCGAA ACUCCCCG | 7853 |
| 4800 | GGGGAGUUA AGUGGUCC | 3710 | GGACCACU CUGAUGAGGNNNNNNNNCCGAA AACUCCCC | 7854 |
| 4807 | UAAGUGGUC CAGUUUGG | 3711 | CCAAACUG CUGAUGAGGNNNNNNNNCCGAA ACCACUUA | 7855 |
| 4812 | GGUCCAGUU UGGCCUAG | 3712 | CUAGGCCA CUGAUGAGGNNNNNNNNCCGAA ACUGGACC | 7856 |
| 4813 | GUCCAGUUU GGCCUAGU | 3713 | ACUAGGCC CUGAUGAGGNNNNNNNNCCGAA AACUGGAC | 7857 |
| 4819 | UUUGGCCUA GUAAGGUU | 3714 | AACCUUAC CUGAUGAGGNNNNNNNNCCGAA AGGCCAAA | 7858 |
| 4822 | GGCCUAGUA AGGUUGCC | 3715 | GGCAACCU CUGAUGAGGNNNNNNNNCCGAA ACUAGGCC | 7859 |
| 4827 | AGUAAGGUU GCCUACUG | 3716 | CAGUAGGC CUGAUGAGGNNNNNNNNCCGAA ACCUUACU | 7860 |
| 4832 | GGUUGCCUA CUGAUGGG | 3717 | CCCAUCAG CUGAUGAGGNNNNNNNNCCGAA AGGCAACC | 7861 |
| 4843 | GAUGGGCUC AAAAGCCA | 3718 | UGGCUUUU CUGAUGAGGNNNNNNNNCCGAA AGCCCAUC | 7862 |
| 4855 | AGCCACAUU UUAAACAG | 3719 | CUGUUUAA CUGAUGAGGNNNNNNNNCCGAA AUGUGGCU | 7863 |
| 4856 | GCCACAUUU UAAACAGG | 3720 | CCUGUUUA CUGAUGAGGNNNNNNNNCCGAA AAUGUGGC | 7864 |
| 4857 | CCACAUUUU AAACAGGU | 3721 | ACCUGUUU CUGAUGAGGNNNNNNNNCCGAA AAAUGUGG | 7865 |
| 4858 | CACAUUUUA AACAGGUU | 3722 | AACCUGUU CUGAUGAGGNNNNNNNNCCGAA AAAAUGUG | 7866 |
| 4866 | AAACAGGUU UAUCUCA | 3723 | UGAGAUAA CUGAUGAGGNNNNNNNNCCGAA ACCUGUUU | 7867 |
| 4867 | AACAGGUUU AUCUCAA | 3724 | UUGAGAUA CUGAUGAGGNNNNNNNNCCGAA AACCUGUU | 7868 |
| 4868 | ACAGGUUUA UCUCAAG | 3725 | CUUGAGAU CUGAUGAGGNNNNNNNNCCGAA AAACCUGU | 7869 |
| 4869 | CAGGUUUAU CUCAAGU | 3726 | ACUUGAGA CUGAUGAGGNNNNNNNNCCGAA AAAACCUG | 7870 |
| 4871 | GGUUUAUCU CAAGUAU | 3727 | AUACUUGA CUGAUGAGGNNNNNNNNCCGAA AUAAACC | 7871 |
| 4873 | UUUUAUCUC AAGUAUUA | 3728 | UAAUACUU CUGAUGAGGNNNNNNNNCCGAA AGAUAAAA | 7872 |
| 4878 | UCUCAAGUA UUAAUAUA | 3729 | UAUAUUAA CUGAUGAGGNNNNNNNNCCGAA ACUUGAGA | 7873 |
| 4880 | UCAAGUAUU AAUAUAUA | 3730 | UAUAUAUU CUGAUGAGGNNNNNNNNCCGAA AUACUUGA | 7874 |
| 4881 | CAAGUAUUA AUAUAUAG | 3731 | CUAUAUAU CUGAUGAGGNNNNNNNNCCGAA AAUACUUG | 7875 |
| 4884 | GUAUUAAUA UAUAGACA | 3732 | UGUCUAUA CUGAUGAGGNNNNNNNNCCGAA AUUAAUAC | 7876 |
| 4886 | AUUAAUAUA UAGACAAG | 3733 | CUUGUCUA CUGAUGAGGNNNNNNNNCCGAA AUAUUAAU | 7877 |
| 4888 | UAAAUAUAUA GACAAGAC | 3734 | GUCUUGUC CUGAUGAGGNNNNNNNNCCGAA AUAUAUUA | 7878 |
| 4900 | AAGCACUU AUGCAUUA | 3735 | UAAUGCAU CUGAUGAGGNNNNNNNNCCGAA AGUGCUU | 7879 |
| 4901 | AGACACUUA UGCAUUAU | 3736 | AUAAUGCA CUGAUGAGGNNNNNNNNCCGAA AAGUGUCU | 7880 |
| 4907 | UUAUGCAUU AUCCUGUU | 3737 | AACAGGAU CUGAUGAGGNNNNNNNNCCGAA AUGCAUAA | 7881 |
| 4908 | UAUGCAUUA UCCUGUUU | 3738 | AAACAGGA CUGAUGAGGNNNNNNNNCCGAA AAUGCAUA | 7882 |
| 4910 | UGCAUUAUC CUGUUUUA | 3739 | UAAAACAG CUGAUGAGGNNNNNNNNCCGAA AUAAUGCA | 7883 |
| 4915 | UAUCCUGUU UUAUAUAU | 3740 | AUAUAUAA CUGAUGAGGNNNNNNNNCCGAA ACAGGAUA | 7884 |
| 4916 | AUCCUGUUU UAUAUAUC | 3741 | GAUAUAUA CUGAUGAGGNNNNNNNNCCGAA AACAGGAU | 7885 |
| 4917 | UCCUGUUUU AUAUAUCC | 3742 | GGAUAUAU CUGAUGAGGNNNNNNNNCCGAA AAACAGGA | 7886 |

TABLE VIII-continued

Mouse *flt*-1 VEGF Receptor-Hammerhead Ribozyme and Substrate Sequence

| Pos | Substrate | Seq ID No | HH Ribozyme Sequence | Seq ID No |
|---|---|---|---|---|
| 4918 | CCUGUUUUA UAUAUCCA | 3743 | UGGAUAUA CUGAUGAGGNNNNNNNNCCGAA AAAACAGG | 7887 |
| 4920 | UGUUUUAUA UAUCCAAU | 3744 | AUUGGAUA CUGAUGAGGNNNNNNNNCCGAA AUAAAACA | 7888 |
| 4922 | UUUUAUAUA UCCAAUGA | 3745 | UCAUUGGA CUGAUGAGGNNNNNNNNCCGAA AUAUAAAA | 7889 |
| 4924 | UUAUAUAUC CAAUGAAU | 3746 | AUUCAUUG CUGAUGAGGNNNNNNNNCCGAA AUAUAUAA | 7890 |
| 4933 | CAAUGAAUA UAACUGGG | 3747 | CCCAGUUA CUGAUGAGGNNNNNNNNCCGAA AUUCAUUG | 7891 |
| 4935 | AUGAAUAUA ACUGGGGC | 3748 | GCCCCAGU CUGAUGAGGNNNNNNNNCCGAA AUAUUCAU | 7892 |
| 4948 | GGGCGAGUU AAGAGUCA | 3749 | UGACUCUU CUGAUGAGGNNNNNNNNCCGAA ACUCGCCC | 7893 |
| 4949 | GGCGAGUUA AGAGUCAU | 3750 | AUGACUCU CUGAUGAGGNNNNNNNNCCGAA AACUCGCC | 7894 |
| 4955 | UUAAGAGUC AUGGUCUA | 3751 | UAGACCAU CUGAUGAGGNNNNNNNNCCGAA ACUCUUAA | 7895 |
| 4961 | GUCAUGGUC UAGAAAAG | 3752 | CUUUUCUA CUGAUGAGGNNNNNNNNCCGAA ACCAUGAC | 7896 |
| 4963 | CAUGGUCUA GAAAAGGG | 3753 | CCCUUUUC CUGAUGAGGNNNNNNNNCCGAA AGACCAUG | 7897 |
| 4974 | AAAGGGGUU UCUCUGUA | 3754 | UACAGAGA CUGAUGAGGNNNNNNNNCCGAA ACCCCUUU | 7898 |
| 4975 | AAGGGGUUU CUCUGUAC | 3755 | GUACAGAG CUGAUGAGGNNNNNNNNCCGAA AACCCCUU | 7899 |
| 4976 | AGGGGUUUC UCUGUACC | 3756 | GGUACAGA CUGAUGAGGNNNNNNNNCCGAA AAACCCCU | 7900 |
| 4978 | GGGUUUCUC UGUACCCA | 3757 | UGGGUACA CUGAUGAGGNNNNNNNNCCGAA AGAAACCC | 7901 |
| 4982 | UUCUCUGUA CCCAAAUC | 3758 | GAUUUGGG CUGAUGAGGNNNNNNNNCCGAA ACAGAGAA | 7902 |
| 4990 | ACCCAAAUC GGGCUGGU | 3759 | ACCAGCCC CUGAUGAGGNNNNNNNNCCGAA AUUUGGGU | 7903 |
| 4999 | GGGCUGGUU GGACCAAG | 3760 | CUUGGUCC CUGAUGAGGNNNNNNNNCCGAA ACCAGCCC | 7904 |
| 5029 | AGAGUGGUU GUCCCAGC | 3761 | GCUGGGAC CUGAUGAGGNNNNNNNNCCGAA ACCACUCU | 7905 |
| 5032 | GUGGUUGUC CCAGCUAU | 3762 | AUAGCUGG CUGAUGAGGNNNNNNNNCCGAA ACAACCAC | 7906 |
| 5039 | UCCCAGCUA UAGUUACU | 3763 | AGUAACUA CUGAUGAGGNNNNNNNNCCGAA AGCUGGGA | 7907 |
| 5041 | CCAGCUAUA GUUACUAA | 3764 | UUAGUAAC CUGAUGAGGNNNNNNNNCCGAA AUAGCUGG | 7908 |
| 5044 | GCUAUAGUU ACUAAACU | 3765 | AGUUUAGU CUGAUGAGGNNNNNNNNCCGAA ACUAUAGC | 7909 |
| 5045 | CUAUAGUUA CUAAACUA | 3766 | UAGUUUAG CUGAUGAGGNNNNNNNNCCGAA AACUAUAG | 7910 |
| 5048 | UAGUUACUA AACUACUC | 3767 | GAGUAGUU CUGAUGAGGNNNNNNNNCCGAA AGUAACUA | 7911 |
| 5053 | ACUAAACUA CUCACCCA | 3768 | UGGGUGAG CUGAUGAGGNNNNNNNNCCGAA AGUUUAGU | 7912 |
| 5056 | AAACUACUC ACCCAAAG | 3769 | CUUUGGGU CUGAUGAGGNNNNNNNNCCGAA AGUAGUUU | 7913 |
| 5066 | CCCAAAGUU GGGACCUC | 3770 | GAGGUCCC CUGAUGAGGNNNNNNNNCCGAA ACUUUGGG | 7914 |
| 5074 | UGGGACCUC ACUGGCUU | 3771 | AAGCCAGU CUGAUGAGGNNNNNNNNCCGAA AGGUCCCA | 7915 |
| 5082 | CACUGGCUU CUCUUUAC | 3772 | GUAAAGAG CUGAUGAGGNNNNNNNNCCGAA AGCCAGUG | 7916 |
| 5083 | ACUGGCUUC UCUUUACU | 3773 | AGUAAAGA CUGAUGAGGNNNNNNNNCCGAA AAGCCAGU | 7917 |
| 5085 | UGGCUUCUC UUUACUUC | 3774 | GAAGUAAA CUGAUGAGGNNNNNNNNCCGAA AGAAGCCA | 7918 |
| 5087 | GCUUCUCUU UACUUCAU | 3775 | AUGAAGUA CUGAUGAGGNNNNNNNNCCGAA AGAGAAGC | 7919 |
| 5088 | CUUCUCUUU ACUUCAUC | 3776 | GAUGAAGU CUGAUGAGGNNNNNNNNCCGAA AAGAGAAG | 7920 |
| 5089 | UUCUCUUUA CUUCAUCA | 3777 | UGAUGAAG CUGAUGAGGNNNNNNNNCCGAA AAAGAGAA | 7921 |
| 5092 | UCUUUACUU CAUCAUGG | 3778 | CCAUGAUG CUGAUGAGGNNNNNNNNCCGAA AGUAAAGA | 7922 |
| 5093 | CUUUACUUC AUCAUGGA | 3779 | UCCAUGAU CUGAUGAGGNNNNNNNNCCGAA AAGUAAAG | 7923 |
| 5096 | UACUUCAUC AUGGAUUU | 3780 | AAAUCCAU CUGAUGAGGNNNNNNNNCCGAA AUGAAGUA | 7924 |
| 5103 | UCAUGGAUU UCACCAUC | 3781 | GAUGGUGA CUGAUGAGGNNNNNNNNCCGAA AUCCAUGA | 7925 |
| 5104 | CAUGGAUUU CACCAUCC | 3782 | GGAUGGUG CUGAUGAGGNNNNNNNNCCGAA AAUCCAUG | 7926 |
| 5105 | AUGGAUUUC ACCAUCCC | 3783 | GGGAUGGU CUGAUGAGGNNNNNNNNCCGAA AAAUCCAU | 7927 |
| 5111 | UUCACCAUC CCAAGGCA | 3784 | UGCCUUGG CUGAUGAGGNNNNNNNNCCGAA AUGGUGAA | 7928 |
| 5122 | AAGGCAGUC UGAGAGGA | 3785 | UCCUCUCA CUGAUGAGGNNNNNNNNCCGAA ACUGCCUU | 7929 |
| 5134 | GAGGAGCUA AAGAGUAU | 3786 | AUACUCUU CUGAUGAGGNNNNNNNNCCGAA AGCUCCUC | 7930 |
| 5141 | UAAAGAGUA UCAGCCCA | 3787 | UGGGCUGA CUGAUGAGGNNNNNNNNCCGAA ACUCUUUA | 7931 |
| 5143 | AAGAGUAUC AGCCCAUA | 3788 | UAUGGGCU CUGAUGAGGNNNNNNNNCCGAA AUACUCUU | 7932 |
| 5151 | CAGCCCAUA UUUAUUAA | 3789 | UUAAUAAA CUGAUGAGGNNNNNNNNCCGAA AUGGGCUG | 7933 |
| 5153 | GCCCAUAUU UAUUAAGC | 3790 | GCUUAAUA CUGAUGAGGNNNNNNNNCCGAA AUAUGGGC | 7934 |
| 5154 | CCCAUAUUU AUUAAGCA | 3791 | UGCUUAAU CUGAUGAGGNNNNNNNNCCGAA AAUAUGGG | 7935 |
| 5155 | CCAUAUUUA UUAAGCAC | 3792 | GUGCUUAA CUGAUGAGGNNNNNNNNCCGAA AAAUAUGG | 7936 |
| 5157 | AUAUUUAUU AAGCACUU | 3793 | AAGUGCUU CUGAUGAGGNNNNNNNNCCGAA AUAAAUAU | 7937 |
| 5158 | UAUUUAUUA AGCACUUU | 3794 | AAAGUGCU CUGAUGAGGNNNNNNNNCCGAA AAUAAAUA | 7938 |
| 5165 | UAAGCACUU UAUGCUCC | 3795 | GGAGCAUA CUGAUGAGGNNNNNNNNCCGAA AGUGCUUA | 7939 |
| 5166 | AAGCACUUU AUGCUCCU | 3796 | AGGAGCAU CUGAUGAGGNNNNNNNNCCGAA AAGUGCUU | 7940 |
| 5167 | AGCACUUUA UGCUCCUU | 3797 | AAGGAGCA CUGAUGAGGNNNNNNNNCCGAA AAAGUGCU | 7941 |
| 5172 | UUUAUGCUC CUUGGCAC | 3798 | GUGCCAAG CUGAUGAGGNNNNNNNNCCGAA AGCAUAAA | 7942 |
| 5175 | AUGCUCCUU GGCACAGC | 3799 | GCUGUGCC CUGAUGAGGNNNNNNNNCCGAA AGGAGCAU | 7943 |
| 5195 | UGAUGUGUA AUUUAUGC | 3800 | GCAUAAAU CUGAUGAGGNNNNNNNNCCGAA ACACAUCA | 7944 |
| 5198 | UGUGUAAUU UAUGCAAG | 3801 | CUUGCAUA CUGAUGAGGNNNNNNNNCCGAA AUUACACA | 7945 |
| 5199 | GUGUAAUUU AUGCAAGC | 3802 | GCUUGCAU CUGAUGAGGNNNNNNNNCCGAA AAUUACAC | 7946 |
| 5200 | UGUAAUUUA UGCAAGCU | 3803 | AGCUUGCA CUGAUGAGGNNNNNNNNCCGAA AAAUUACA | 7947 |
| 5209 | UGCAAGCUC CUCUCCA | 3804 | UGGAGAGG CUGAUGAGGNNNNNNNNCCGAA AGCUUGCA | 7948 |
| 5213 | AGCUCCUC UCCAGCUA | 3805 | UAGCUGGA CUGAUGAGGNNNNNNNNCCGAA AGGGAGCU | 7949 |
| 5215 | CUCCCUCUC CAGCUAGG | 3806 | CCUAGCUG CUGAUGAGGNNNNNNNNCCGAA AGAGGGAG | 7950 |
| 5221 | CUCCAGCUA GGACUCAG | 3807 | CUGAGUCC CUGAUGAGGNNNNNNNNCCGAA AGCUGGAG | 7951 |
| 5227 | CUAGGACUC AGGAUAUU | 3808 | AAUAUCCU CUGAUGAGGNNNNNNNNCCGAA AGUCCUAG | 7952 |
| 5233 | CUCAGGAUA UUAGUCAA | 3809 | UUGACUAA CUGAUGAGGNNNNNNNNCCGAA AUCCUGAG | 7953 |
| 5235 | CAGGAUAUU AGUCAAUG | 3810 | CAUUGACU CUGAUGAGGNNNNNNNNCCGAA AUAUCCUG | 7954 |
| 5236 | AGGAUAUUA GUCAAUGA | 3811 | UCAUUGAC CUGAUGAGGNNNNNNNNCCGAA AAUAUCCU | 7955 |
| 5239 | AUAUUAGUC AAUGAGCC | 3812 | GGCUCAUU CUGAUGAGGNNNNNNNNCCGAA ACUAAUAU | 5095 |
| 5250 | UGAGCCAUC AAAAGGAA | 3813 | UUCCUUUU CUGAUGAGGNNNNNNNNCCGAA AUGGCUCA | 7956 |
| 5273 | AAAAACCUA UCUUAUUU | 3814 | AAAUAAGA CUGAUGAGGNNNNNNNNCCGAA AGGUUUUU | 7957 |
| 5275 | AAACCUAUC UUAUUUUC | 3815 | GAAAAUAA CUGAUGAGGNNNNNNNNCCGAA AUAGGUUU | 7958 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5277 | ACCUAUCUU AUUUUCAU | 3816 | AUGAAAAU CUGAUGAGGNNNNNNNNCCGAA AGAUAGGU | 7959 |
| 5278 | CCUAUCUUA UUUUCAUC | 3817 | GAUGAAAA CUGAUGAGGNNNNNNNNCCGAA AAGAUAGG | 7960 |
| 5280 | UAUCUUAUU UUCAUCUG | 3818 | CAGAUGAA CUGAUGAGGNNNNNNNNCCGAA AUAAGAUA | 7961 |
| 5281 | AUCUUAUUU UCAUCUGU | 3819 | ACAGAUGA CUGAUGAGGNNNNNNNNCCGAA AAUAAGAU | 7962 |
| 5282 | UCUUAUUUU CAUCUGUU | 3820 | AACAGAUG CUGAUGAGGNNNNNNNNCCGAA AAAUAAGA | 7963 |
| 5283 | CUUAUUUUC AUCUGUUU | 3821 | AAACAGAU CUGAUGAGGNNNNNNNNCCGAA AAAAUAAG | 7964 |
| 5286 | AUUUUCAUC UGUUUCAU | 3822 | AUGAAACA CUGAUGAGGNNNNNNNNCCGAA AUGAAAAU | 7965 |
| 5290 | UCAUCUGUU UCAUACCU | 3823 | AGGUAUGA CUGAUGAGGNNNNNNNNCCGAA ACAGAUGA | 7966 |
| 5291 | CAUCUGUUU CAUACCUU | 3824 | AAGGUAUG CUGAUGAGGNNNNNNNNCCGAA AACAGAUG | 7967 |
| 5292 | AUCUGUUUC AUACCUUG | 3825 | CAAGGUAU CUGAUGAGGNNNNNNNNCCGAA AAACAGAU | 7968 |
| 5295 | UGUUUCAUA CCUUGUCU | 3826 | AGACAAGG CUGAUGAGGNNNNNNNNCCGAA AUGAAACA | 7969 |
| 5299 | UCAUACCUU GUCUGGGG | 3827 | CCCCAGAC CUGAUGAGGNNNNNNNNCCGAA AGGUAUGA | 7970 |
| 5302 | UACCUUGUC UGGGGUCU | 3828 | AGACCCCA CUGAUGAGGNNNNNNNNCCGAA ACAAGGUA | 7971 |
| 5309 | UCUGGGGUC UAAUGACG | 3829 | CGUCAUUA CUGAUGAGGNNNNNNNNCCGAA ACCCCAGA | 7972 |
| 5311 | UGGGGUCUA AUGACGAU | 3830 | AUCGUCAU CUGAUGAGGNNNNNNNNCCGAA AGACCCCA | 7973 |
| 5331 | AACAGGGUA GACAUGGG | 3831 | CCCAUGUC CUGAUGAGGNNNNNNNNCCGAA ACCCUGUU | 7974 |
| 5350 | GACAGGGUA GAAAAGGG | 3832 | CCCUUUUC CUGAUGAGGNNNNNNNNCCGAA ACCCUGUC | 7975 |
| 5367 | UGCCCGCUC UUUGGGGU | 3833 | ACCCCAAA CUGAUGAGGNNNNNNNNCCGAA AGCGGGCA | 7976 |
| 5369 | CCCGCUCUU UGGGGUCU | 3834 | AGACCCCA CUGAUGAGGNNNNNNNNCCGAA AGAGCGGG | 7977 |
| 5370 | CCGCUCUUU GGGGUCUA | 3835 | UAGACCCC CUGAUGAGGNNNNNNNNCCGAA AAGAGCGG | 7978 |
| 5376 | UUUGGGGUC UAGAGAUG | 3836 | CAUCUCUA CUGAUGAGGNNNNNNNNCCGAA ACCCCAAA | 7979 |
| 5378 | UGGGGUCUA GAGAUGAG | 3837 | CUCAUCUC CUGAUGAGGNNNNNNNNCCGAA AGACCCCA | 7980 |
| 5395 | CCCUGGGUC UCUAAAAU | 3838 | AUUUUAGA CUGAUGAGGNNNNNNNNCCGAA ACCCAGGG | 7981 |
| 5397 | CUGGGUCUC UAAAAUGG | 3839 | CCAUUUUA CUGAUGAGGNNNNNNNNCCGAA AGACCCAG | 7982 |
| 5399 | GGGUCUCUA AAAUGGCU | 3840 | AGCCAUUU CUGAUGAGGNNNNNNNNCCGAA AGAGACCC | 7983 |
| 5408 | AAAUGGCUC UCUUAGAA | 3841 | UUCUAAGA CUGAUGAGGNNNNNNNNCCGAA AGCCAUUU | 7984 |
| 5410 | AUGGCUCUC UUAGAAGU | 3842 | ACUUCUAA CUGAUGAGGNNNNNNNNCCGAA AGAGCCAU | 7985 |
| 5412 | GGCUCUCUU AGAAGUUG | 3843 | CAACUUCU CUGAUGAGGNNNNNNNNCCGAA AGAGAGCC | 7986 |
| 5413 | GCUCUCUUA GAAGUUGU | 3844 | ACAACUUC CUGAUGAGGNNNNNNNNCCGAA AAGAGAGC | 7987 |
| 5419 | UUAGAAGUU GUAUGUGC | 3845 | GCACAUAC CUGAUGAGGNNNNNNNNCCGAA ACUUCUAA | 7988 |
| 5422 | GAAGUUGUA UGUGCAAA | 3846 | UUUGCACA CUGAUGAGGNNNNNNNNCCGAA ACAACUUC | 7989 |
| 5432 | GUGCAAAUU AUGGUCUG | 3847 | CAGACCAU CUGAUGAGGNNNNNNNNCCGAA AUUUGCAC | 7990 |
| 5433 | UGCAAAUUA UGGUCUGU | 3848 | ACAGACCA CUGAUGAGGNNNNNNNNCCGAA AAUUUGCA | 7991 |
| 5438 | AUUAUGGUC UGUGUGCU | 3849 | AGCACACA CUGAUGAGGNNNNNNNNCCGAA ACCAUAAU | 7992 |
| 5447 | UGUGUGCUU AGGUCGUG | 3850 | CACGACCU CUGAUGAGGNNNNNNNNCCGAA AGCACACA | 7993 |
| 5448 | GUGUGCUUA GGUCGUGC | 3851 | GCACGACC CUGAUGAGGNNNNNNNNCCGAA AAGCACAC | 7994 |
| 5452 | GCUUAGGUC GUGCACAC | 3852 | GUGUGCAC CUGAUGAGGNNNNNNNNCCGAA ACCUAAGC | 7995 |
| 5475 | GAGCCGGUC ACAGCUGG | 3853 | CCAGCUGU CUGAUGAGGNNNNNNNNCCGAA ACCGGCUC | 7996 |
| 5497 | CGAUGAAUA GCUGCUUU | 3854 | AAAGCAGC CUGAUGAGGNNNNNNNNCCGAA AUUCAUCG | 7997 |
| 5504 | UAGCUGCUU UGGGAGAG | 3855 | CUCUCCCA CUGAUGAGGNNNNNNNNCCGAA AGCAGCUA | 7998 |
| 5505 | AGCUGCUUU GGGAGAGC | 3856 | GCUCUCCC CUGAUGAGGNNNNNNNNCCGAA AAGCAGCU | 7999 |
| 5524 | AGCAUGCUA GCCACUUA | 3857 | UAAGUGGC CUGAUGAGGNNNNNNNNCCGAA AGCAUGCU | 8000 |
| 5531 | UAGCCACUU AAUUCUCU | 3858 | AGAGAAUU CUGAUGAGGNNNNNNNNCCGAA AGUGGCUA | 8001 |
| 5532 | AGCCACUUA AUUCUCUG | 3859 | CAGAGAAU CUGAUGAGGNNNNNNNNCCGAA AAGUGGCU | 8002 |
| 5535 | CACUUAAUU CUCUGACC | 3860 | GGUCAGAG CUGAUGAGGNNNNNNNNCCGAA AUUAAGUG | 8003 |
| 5536 | ACUUAAUUC UCUGACCG | 3861 | CGGUCAGA CUGAUGAGGNNNNNNNNCCGAA AAUUAAGU | 8004 |
| 5538 | UUAAUUCUC UGACCGGG | 3862 | CCCGGUCA CUGAUGAGGNNNNNNNNCCGAA AGAAUUAA | 8005 |
| 5554 | GCCAGCAUC AUGGGUAC | 3863 | GUACCCAU CUGAUGAGGNNNNNNNNCCGAA AUGCUGGC | 8006 |
| 5561 | UCAUGGGUA CCUGCUCC | 3864 | GGAGCAGG CUGAUGAGGNNNNNNNNCCGAA ACCCAUGA | 8007 |
| 5568 | UACCUGCUC CCUGUGUU | 3865 | ACACAGGG CUGAUGAGGNNNNNNNNCCGAA AGCAGGUA | 8008 |
| 5577 | CCCUGUGUA CCCCAUCC | 3866 | GGAUGGGG CUGAUGAGGNNNNNNNNCCGAA ACACAGGG | 8009 |
| 5584 | UACCCCAUC CUUAAGGU | 3867 | ACCUUAAG CUGAUGAGGNNNNNNNNCCGAA AUGGGGUA | 8010 |
| 5587 | CCCAUCCUU AAGGUUUU | 3868 | AAAACCUU CUGAUGAGGNNNNNNNNCCGAA AGGAUGGG | 8011 |
| 5588 | CCAUCCUUA AGGUUUUC | 3869 | GAAAACCU CUGAUGAGGNNNNNNNNCCGAA AAGGAUGG | 8012 |
| 5593 | CUUAAGGUU UUCUGUCU | 3870 | AGACAGAA CUGAUGAGGNNNNNNNNCCGAA ACCUUAAG | 8013 |
| 5594 | UUAAGGUUU UCUGUCUG | 3871 | CAGACAGA CUGAUGAGGNNNNNNNNCCGAA AACCUUAA | 8014 |
| 5595 | UAAGGUUUU CUGUCUGA | 3872 | UCAGACAG CUGAUGAGGNNNNNNNNCCGAA AAACCUUA | 8015 |
| 5596 | AAGGUUUUC UGUCUGAU | 3873 | AUCAGACA CUGAUGAGGNNNNNNNNCCGAA AAAACCUU | 8016 |
| 5600 | UUUUCUGUC UGAUGAGA | 3874 | UCUCAUCA CUGAUGAGGNNNNNNNNCCGAA ACAGAAAA | 8017 |
| 5627 | AGUGCAAUC CCCACUGA | 3875 | UCAGUGGG CUGAUGAGGNNNNNNNNCCGAA AUUGCACU | 8018 |
| 5660 | CUGUGGCUC UUGGUGCA | 3876 | UGCACCAA CUGAUGAGGNNNNNNNNCCGAA AGCCACAG | 8019 |
| 5662 | GUGGCUCUU GGUGCACU | 3877 | AGUGCACC CUGAUGAGGNNNNNNNNCCGAA AGAGCCAC | 8020 |
| 5671 | GGUGCACUC ACCAGCCA | 3878 | UGGCUGGU CUGAUGAGGNNNNNNNNCCGAA AGUGCACC | 8021 |
| 5685 | CCAGGACUA GACAAGUA | 3879 | UACUUGUC CUGAUGAGGNNNNNNNNCCGAA AGUCCUGG | 8022 |
| 5693 | AGACAAGUA GGAAAGGG | 3880 | CCCUUUCC CUGAUGAGGNNNNNNNNCCGAA ACUUGUCU | 8023 |
| 5704 | AAAGGGCUU CUAGCCAC | 3881 | GUGGCUAG CUGAUGAGGNNNNNNNNCCGAA AGCCCUUU | 8024 |
| 5705 | AAGGGCUUC UAGCCACA | 3882 | UGUGGCUA CUGAUGAGGNNNNNNNNCCGAA AAGCCCUU | 8025 |
| 5707 | GGGCUUCUA GCCACACU | 3883 | AGUGUGGC CUGAUGAGGNNNNNNNNCCGAA AGAAGCCC | 8026 |
| 5731 | AAGAAAAUC AGGUAGGG | 3884 | CCCUACCU CUGAUGAGGNNNNNNNNCCGAA AUUUUCUU | 8027 |
| 5736 | AAUCAGGUA GGGCUGGC | 3885 | GCCAGCCC CUGAUGAGGNNNNNNNNCCGAA ACCUGAUU | 8028 |
| 5754 | AAAGACAUC UUUGUCCA | 3886 | UGGACAAA CUGAUGAGGNNNNNNNNCCGAA AUGUCUUU | 8029 |
| 5756 | AGACAUCUU UGUCCAUU | 3887 | AAUGGACA CUGAUGAGGNNNNNNNNCCGAA AGAUGUCU | 8030 |
| 5757 | GACAUCUUU GUCCAUUC | 3888 | GAAUGGAC CUGAUGAGGNNNNNNNNCCGAA AAGAUGUC | 8031 |

TABLE VIII-continued

Mouse flt-1 VEGF Receptor-Hammerhead Ribozyme and Substrate Sequence

| Pos | Substrate | Seq ID No | HH Ribozyme Sequence | Seq ID No |
|---|---|---|---|---|
| 5760 | AUCUUUGUC CAUUCGCA | 3889 | UGCGAAUG CUGAUGAG<u>GNNNNNNNN</u>CCGAA ACAAAGAU | 8032 |
| 5764 | UUGUCCAUU CGCAAAAG | 3890 | CUUUUGCG CUGAUGAG<u>GNNNNNNNN</u>CCGAA AUGGACAA | 8033 |
| 5765 | UGUCCAUUC GCAAAAGC | 3891 | GCUUUUGC CUGAUGAG<u>GNNNNNNNN</u>CCGAA AAUGGACA | 8034 |
| 5775 | CAAAAGCUC UUGUCGGC | 3892 | GCCGACAA CUGAUGAG<u>GNNNNNNNN</u>CCGAA AGCUUUUG | 8035 |
| 5777 | AAAGCUCUU GUCGGCUG | 3893 | CAGCCGAC CUGAUGAG<u>GNNNNNNNN</u>CCGAA AGAGCUUU | 8036 |
| 5780 | GCUCUUGUC GGCUGCAG | 3894 | CUGCAGCC CUGAUGAG<u>GNNNNNNNN</u>CCGAA ACAAGAGC | 8037 |
| 5794 | CAGUGUGUA AGUCAGGC | 3895 | GCCUGACU CUGAUGAG<u>GNNNNNNNN</u>CCGAA ACACACUG | 8038 |
| 5798 | GUGUAAGUC AGGCGAUG | 3896 | CAUCGCCU CUGAUGAG<u>GNNNNNNNN</u>CCGAA ACUUACAC | 8039 |
| 5818 | CAGAGGCUA CCAGAGAA | 3897 | UUCUCUGG CUGAUGAG<u>GNNNNNNNN</u>CCGAA AGCCUCUG | 8040 |
| 5852 | CCUGAGGUU UCUCAUCC | 3898 | GGAUGAGA CUGAUGAG<u>GNNNNNNNN</u>CCGAA ACCUCAGG | 8041 |
| 5853 | CUGAGGUUU CUCAUCCA | 3899 | UGGAUGAG CUGAUGAG<u>GNNNNNNNN</u>CCGAA AACCUCAG | 8042 |
| 5854 | UGAGGUUUC UCAUCCAG | 3900 | CUGGAUGA CUGAUGAG<u>GNNNNNNNN</u>CCGAA AAACCUCA | 8043 |
| 5856 | AGGUUUCUC AUCCAGAU | 3901 | AUCUGGAU CUGAUGAG<u>GNNNNNNNN</u>CCGAA AGAAACCU | 8044 |
| 5859 | UUUCUCAUC CAGAUAUC | 3902 | GAUAUCUG CUGAUGAG<u>GNNNNNNNN</u>CCGAA AUGAGAAA | 8045 |
| 5865 | AUCCAGAUA UCCAGCAA | 3903 | UUGCUGGA CUGAUGAG<u>GNNNNNNNN</u>CCGAA AUCUGGAU | 8046 |
| 5867 | CCAGAUAUC CAGCAAUU | 3904 | AAUUGCUG CUGAUGAG<u>GNNNNNNNN</u>CCGAA AUAUCUGG | 8047 |
| 5875 | CCAGCAAUU GGGGGUG | 3905 | CACCCCCC CUGAUGAG<u>GNNNNNNNN</u>CCGAA AUUGCUGG | 8048 |
| 5896 | AAGACCAUA GAUGGUCC | 3906 | GGACCAUC CUGAUGAG<u>GNNNNNNNN</u>CCGAA AUGGUCUU | 8049 |
| 5903 | UAGAUGGUC CUGUAUUA | 3907 | UAAUACAG CUGAUGAG<u>GNNNNNNNN</u>CCGAA ACCAUCUA | 8050 |
| 5908 | GGUCCUGUA UUAUUCCG | 3908 | CGGAAUAA CUGAUGAG<u>GNNNNNNNN</u>CCGAA ACAGGACC | 8051 |
| 5910 | UCCUGUAUU AUUCCGAU | 3909 | AUCGGAAU CUGAUGAG<u>GNNNNNNNN</u>CCGAA AUACAGGA | 8052 |
| 5911 | CCUGUAUUA UUCCGAUU | 3910 | AAUCGGAA CUGAUGAG<u>GNNNNNNNN</u>CCGAA AAUACAGG | 8053 |
| 5913 | UGUAUUAUU CCGAUUUU | 3911 | AAAAUCGG CUGAUGAG<u>GNNNNNNNN</u>CCGAA AUAAUACA | 8054 |
| 5914 | GUAUUAUUC CGAUUUUA | 3912 | UAAAAUCG CUGAUGAG<u>GNNNNNNNN</u>CCGAA AAUAAUAC | 8055 |
| 5919 | AUUCCGAUU UUAAUAAU | 3913 | AUUAUUAA CUGAUGAG<u>GNNNNNNNN</u>CCGAA AUCGGAAU | 8056 |
| 5920 | UUCCGAUUU UAAUAAUC | 3914 | GAUUAUUA CUGAUGAG<u>GNNNNNNNN</u>CCGAA AAUCGGAA | 8057 |
| 5921 | UCCGAUUUU AAUAAUCU | 3915 | AGAUUAUU CUGAUGAG<u>GNNNNNNNN</u>CCGAA AAAUCGGA | 8058 |
| 5922 | CCGAUUUUA AUAAUCUA | 3916 | UAGAUUAU CUGAUGAG<u>GNNNNNNNN</u>CCGAA AAAAUCGG | 8059 |
| 5925 | AUUUUAAUA AUCUAAUU | 3917 | AAUUAGAU CUGAUGAG<u>GNNNNNNNN</u>CCGAA AUUAAAAU | 8060 |
| 5928 | UUAAUAAUC UAAUUCGU | 3918 | ACGAAUUA CUGAUGAG<u>GNNNNNNNN</u>CCGAA AUUAUUAA | 8061 |
| 5930 | AAUAAUCUA AUUCGUGA | 3919 | UCACGAAU CUGAUGAG<u>GNNNNNNNN</u>CCGAA AGAUUAUU | 8062 |
| 5933 | AAUCUAAUU CGUGAUCA | 3920 | UGAUCACG CUGAUGAG<u>GNNNNNNNN</u>CCGAA AUUAGAUU | 8063 |
| 5934 | AUCUAAUUC GUGAUCAU | 3921 | AUGAUCAC CUGAUGAG<u>GNNNNNNNN</u>CCGAA AAUUAGAU | 8064 |
| 5940 | UUCGUGAUC AUUAAGAG | 3922 | CUCUUAAU CUGAUGAG<u>GNNNNNNNN</u>CCGAA AUCACGAA | 8065 |
| 5943 | GUGAUCAUU AAGAGACU | 3923 | AGUCUCUU CUGAUGAG<u>GNNNNNNNN</u>CCGAA AUGAUCAC | 8066 |
| 5944 | UGAUCAUUA AGAGACUU | 3924 | AAGUCUCU CUGAUGAG<u>GNNNNNNNN</u>CCGAA AAUGAUCA | 8067 |
| 5952 | AAGAGACUU UAGUAAAU | 3925 | AUUUACUA CUGAUGAG<u>GNNNNNNNN</u>CCGAA AGUCUCUU | 8068 |
| 5953 | AGAGACUUU AGUAAAUG | 3926 | CAUUUACU CUGAUGAG<u>GNNNNNNNN</u>CCGAA AAGUCUCU | 8069 |
| 5954 | GAGACUUUA GUAAAUGU | 3927 | ACAUUUAC CUGAUGAG<u>GNNNNNNNN</u>CCGAA AAAGUCUC | 8070 |
| 5957 | ACUUUAGUA AAUGUCCC | 3928 | GGGACAUU CUGAUGAG<u>GNNNNNNNN</u>CCGAA ACUAAAGU | 8071 |
| 5963 | GUAAAUGUC CCUUUUCC | 3929 | GGAAAAGG CUGAUGAG<u>GNNNNNNNN</u>CCGAA ACAUUUAC | 8072 |
| 5967 | AUGUCCCUU UUCCCACA | 3930 | UGUGGGAA CUGAUGAG<u>GNNNNNNNN</u>CCGAA AGGGACAU | 8073 |
| 5968 | UGUCCCUUU UCCCACAA | 3931 | UUGUGGGA CUGAUGAG<u>GNNNNNNNN</u>CCGAA AAGGGACA | 8074 |
| 5969 | GUCCCUUUU CCCACAAA | 3932 | UUUGUGGG CUGAUGAG<u>GNNNNNNNN</u>CCGAA AAAGGGAC | 8075 |
| 5970 | UCCCUUUUC CCACAAAA | 3933 | UUUUGUGG CUGAUGAG<u>GNNNNNNNN</u>CCGAA AAAAGGGA | 8076 |
| 5981 | ACAAAAGUA AAGAAAAG | 3934 | CUUUUCUU CUGAUGAG<u>GNNNNNNNN</u>CCGAA ACUUUUGU | 8077 |
| 5992 | GAAAAGCUA UCGGGAUU | 3935 | AAUCCCGA CUGAUGAG<u>GNNNNNNNN</u>CCGAA AGCUUUUC | 8078 |
| 5994 | AAAGCUAUC GGGAUUCU | 3936 | AGAAUCCC CUGAUGAG<u>GNNNNNNNN</u>CCGAA AUAGCUUU | 8079 |
| 6000 | AUCGGGAUU CUCUGGUU | 3937 | AACCAGAG CUGAUGAG<u>GNNNNNNNN</u>CCGAA AUCCCGAU | 8080 |
| 6001 | UCGGGAUUC UCUGGUUC | 3938 | GAACCAGA CUGAUGAG<u>GNNNNNNNN</u>CCGAA AAUCCCGA | 8081 |
| 6003 | GGGAUUCUC UGGUUCUG | 3939 | CAGAACCA CUGAUGAG<u>GNNNNNNNN</u>CCGAA AGAAUCCC | 8082 |
| 6008 | UCUCUGGUU CUGCUUAA | 3940 | UUAAGCAG CUGAUGAG<u>GNNNNNNNN</u>CCGAA ACCAGAGA | 8083 |
| 6009 | CUCUGGUUC UGCUUAAA | 3941 | UUUAAGCA CUGAUGAG<u>GNNNNNNNN</u>CCGAA AACCAGAG | 8084 |
| 6014 | GUUCUGCUU AAAGACUU | 3942 | AAGUCUUU CUGAUGAG<u>GNNNNNNNN</u>CCGAA AGCAGAAC | 8085 |
| 6015 | UUCUGCUUA AAGACUUA | 3943 | UAGUCUUU CUGAUGAG<u>GNNNNNNNN</u>CCGAA AAGCAGAA | 8086 |
| 6022 | UAAAGACUU AGCUUUGG | 3944 | CCAAAGCU CUGAUGAG<u>GNNNNNNNN</u>CCGAA AGUCUUUA | 8087 |
| 6023 | AAAGACUUA GCUUUGGA | 3945 | UCCAAAGC CUGAUGAG<u>GNNNNNNNN</u>CCGAA AAGUCUUU | 8088 |
| 6027 | ACUUAGCUU UGGAGCCU | 3946 | AGGCUCCA CUGAUGAG<u>GNNNNNNNN</u>CCGAA AGCUAAGU | 8089 |
| 6028 | CUUAGCUUU GGAGCCUA | 3947 | UAGGCUCC CUGAUGAG<u>GNNNNNNNN</u>CCGAA AAGCUAAG | 8090 |
| 6036 | UGGAGCCUA UGAAAGUU | 3948 | AACUUUCA CUGAUGAG<u>GNNNNNNNN</u>CCGAA AGGCUCCA | 8091 |
| 6044 | AUGAAAGUU GAUCAGCC | 3949 | GGCUGAUC CUGAUGAG<u>GNNNNNNNN</u>CCGAA ACUUUCAU | 8092 |

Where "X" represents stem II region of a HH ribozyme (Hertel et al., 1992 Nucleic Acids Res. 20 3252). The length of stem II may be ≧2 base-pairs.
Underlined region can be any X sequence or linker, as described herein.

TABLE IX

Mouse flt1 VEGF Receptor-Hairpin Ribozyme and Substrate Sequence

| Pos | Substrate | Seq ID No | HP Ribozyme | Seq ID No |
|---|---|---|---|---|
| 33 | AUGGUCA GCU GCUGGGAC | 3950 | GUCCCAGC AGAA GACCAU ACCAGAGAAACACACGUUGUGGUACAUUACCUGGUA | 8093 |
| 36 | GUCAGCU GCU GGGACACC | 3951 | GGUGUCCC AGAA GCUGAC ACCAGAGAAACACACGUUGUGGUACAUUACCUGGUA | 8094 |
| 50 | CACCGCG GCU UUGCCUUA | 3952 | UAAGGCAA AGAA GCGGUG ACCAGAGAAACACACGUUGUGGUACAUUACCUGGUA | 8095 |
| 67 | ACGCGCU GCU CGGGUGUC | 3953 | GACACCCG AGAA GCGCGU ACCAGAGAAACACACGUUGUGGUACAUUACCUGGUA | 8096 |
| 79 | GGUGUCU GCU UCUCACAG | 3954 | CUGUGAGA AGAA GACACC ACCAGAGAAACACACGUUGUGGUACAUUACCUGGUA | 8097 |
| 166 | CAGGCCA GAC UCUCUUUC | 3955 | GAAAGAGA AGAA GGCCUG ACCAGAGAAACACACGUUGUGGUACAUUACCUGGUA | 8098 |
| 197 | GGAGGCA GCC CACUCAUG | 3956 | CAUGAGUG AGAA GCCUCC ACCAGAGAAACACACGUUGUGGUACAUUACCUGGUA | 8099 |
| 214 | GGUCUCU GCC CACGACCG | 3957 | CGGUCGUG AGAA GAGACC ACCAGAGAAACACACGUUGUGGUACAUUACCUGGUA | 8100 |
| 266 | CCCAUCG GCC UGUGGGAG | 3958 | CUCCCACA AGAA GAUGGG ACCAGAGAAACACACGUUGUGGUACAUUACCUGGUA | 8101 |
| 487 | GAAGACA GCU CAUCAUCC | 3959 | GGAUGAUG AGAA GUCUUC ACCAGAGAAACACACGUUGUGGUACAUUACCUGGUA | 8102 |
| 501 | AUCCCCU GCU GGGUGACG | 3960 | CGUCACCC AGAA GGGGAU ACCAGAGAAACACACGUUGUGGUACAUUACCUGGUA | 8103 |
| 566 | UACCCCU GAU GGGCAAAG | 3961 | CUUUGCCC AGAA GGGGUA ACCAGAGAAACACACGUUGUGGUACAUUACCUGGUA | 8104 |
| 640 | UAGGACU GCU GAACUGCG | 3962 | CGCAGUUC AGAA GUCCUA ACCAGAGAAACACACGUUGUGGUACAUUACCUGGUA | 8105 |
| 691 | ACUAUCU GAC CCAUCGGC | 3963 | GCCGAUGG AGAA GAUAGU ACCAGAGAAACACACGUUGUGGUACAUUACCUGGUA | 8106 |
| 703 | AUCGGCA GCC CAAUACAA | 3964 | UUGUAUUG AGAA GCCGAU ACCAGAGAAACACACGUUGUGGUACAUUACCUGGUA | 8107 |
| 736 | UACGCCC GCC GAGCCCAG | 3965 | CUGGGCUC AGAA GGCGUA ACCAGAGAAACACACGUUGUGGUACAUUACCUGGUA | 8108 |
| 754 | UGAGACU GCU CCACGGGC | 3966 | GCCCGUGG AGAA GUCUCA ACCAGAGAAACACACGUUGUGGUACAUUACCUGGUA | 8109 |
| 766 | ACGGGCA GAC UCUUGUCC | 3967 | GGACAAGA AGAA GCCCGU ACCAGAGAAACACACGUUGUGGUACAUUACCUGGUA | 8110 |
| 871 | GGCAGCG GAU UGACCGGA | 3968 | UCCGGUCA AGAA GCUGCC ACCAGAGAAACACACGUUGUGGUACAUUACCUGGUA | 8111 |
| 960 | UACACCU GUC GCGUGAAG | 3969 | CUUCACGC AGAA GGUGUA ACCAGAGAAACACACGUUGUGGUACAUUACCUGGUA | 8112 |
| 988 | CGUUCCA GUC UUUCAACA | 3970 | UGUUGAAA AGAA GGAACG ACCAGAGAAACACACGUUGUGGUACAUUACCUGGUA | 8113 |
| 1051 | GGAAGCA GCC GGUGCAGG | 3971 | CCUGCACC AGAA GCUUCC ACCAGAGAAACACACGUUGUGGUACAUUACCUGGUA | 8114 |
| 1081 | GAAGACG GUC CUAUCGGC | 3972 | GCCGAUAG AGAA GUCUUC ACCAGAGAAACACACGUUGUGGUACAUUACCUGGUA | 8115 |
| 1090 | CCUAUCG GCU GUCCAUGA | 3973 | UCAUGGAC AGAA GAUAGG ACCAGAGAAACACACGUUGUGGUACAUUACCUGGUA | 8116 |
| 1093 | AUCGGCU GUC CAUGAAAG | 3974 | CUUUCAUG AGAA GCCGAU ACCAGAGAAACACACGUUGUGGUACAUUACCUGGUA | 8117 |
| 1169 | GAAGUCU GCU CGCUAUUU | 3975 | AAAUAGCG AGAA GACUUC ACCAGAGAAACACACGUUGUGGUACAUUACCUGGUA | 8118 |
| 1315 | AACCUCA GAU CUACGAAA | 3976 | UUUCGUAG AGAA GAGGUU ACCAGAGAAACACACGUUGUGGUACAUUACCUGGUA | 8119 |
| 1363 | UCUAUCC GCU GGGCAGCA | 3977 | UGCUGCCC AGAA GAUAGA ACCAGAGAAACACACGUUGUGGUACAUUACCUGGUA | 8120 |
| 1604 | GGUGGCU GAC UCUCAGAC | 3978 | GUCUGAGA AGAA GCCACC ACCAGAGAAACACACGUUGUGGUACAUUACCUGGUA | 8121 |
| 1612 | ACUCUCA GAC CCCUGGAA | 3979 | UUCCAGGG AGAA GAGAGU ACCAGAGAAACACACGUUGUGGUACAUUACCUGGUA | 8122 |
| 1629 | AUCUACA GCU GCCGGGCC | 3980 | GGCCCGGC AGAA GUAGAU ACCAGAGAAACACACGUUGUGGUACAUUACCUGGUA | 8123 |
| 1632 | UACAGCU GCC GGGCCUUC | 3981 | GAAGGCCC AGAA GCUGUA ACCAGAGAAACACACGUUGUGGUACAUUACCUGGUA | 8124 |
| 1688 | UGUCACA GAU GUGCCGAA | 3982 | UUCGGCAC AGAA GUGACA ACCAGAGAAACACACGUUGUGGUACAUUACCUGGUA | 8125 |
| 1730 | GAUGCCA GCC GAAGGAGA | 3983 | UCUCCUUC AGAA GGCAUC ACCAGAGAAACACACGUUGUGGUACAUUACCUGGUA | 8126 |
| 1753 | UGAAACU GUC CUGUGUGG | 3984 | CCACACAG AGAA GUUUCA ACCAGAGAAACACACGUUGUGGUACAUUACCUGGUA | 8127 |
| 2017 | CACACCU GCU UCAAAACC | 3985 | GGUUUUGA AGAA GGUGUG ACCAGAGAAACACACGUUGUGGUACAUUACCUGGUA | 8128 |
| 2101 | CGCCUCA GAU CACUUGGU | 3986 | ACCAAGUG AGAA GAGGCG ACCAGAGAAACACACGUUGUGGUACAUUACCUGGUA | 8129 |
| 2176 | GCACGCU GUU UAUUGAAA | 1441 | UUUCAAUA AGAA GCGUGC ACCAGAGAAACACACGUUGUGGUACAUUACCUGGUA | 5597 |
| 2258 | AAGCGCA GCC UACCUCAC | 3987 | GUGAGGUA AGAA GCGCUU ACCAGAGAAACACACGUUGUGGUACAUUACCUGGUA | 8130 |
| 2305 | UGGAGCU GAU CACGCUCA | 3988 | UGAGCGUG AGAA GCUCCA ACCAGAGAAACACACGUUGUGGUACAUUACCUGGUA | 8131 |
| 2383 | UGAAGCG GUC UUCUUCCG | 3989 | CGGAAGAA AGAA GCUUCA ACCAGAGAAACACACGUUGUGGUACAUUACCUGGUA | 8132 |
| 2405 | AAAGACA GAC UACCUGUC | 3990 | GACAGGUA AGAA GUCUUU ACCAGAGAAACACACGUUGUGGUACAUUACCUGGUA | 8133 |
| 2432 | GGACCCA GAU GAAGUUCC | 1445 | GGAACUUC AGAA GGGUCC ACCAGAGAAACACACGUUGUGGUACAUUACCUGGUA | 5601 |
| 2464 | GUGAACG GCU GCCCUAUG | 3991 | CAUAGGGC AGAA GUUCAC ACCAGAGAAACACACGUUGUGGUACAUUACCUGGUA | 8134 |
| 2467 | AACGGCU GCC CUAUGAUG | 3992 | CAUCAUAG AGAA GCCGUU ACCAGAGAAACACACGUUGUGGUACAUUACCUGGUA | 8135 |
| 2592 | CCCACCU GCC GGACUGUG | 3993 | CACAGUCC AGAA GGUGGG ACCAGAGAAACACACGUUGUGGUACAUUACCUGGUA | 8136 |
| 2596 | CCUGCCG GAC UGUGGCUG | 3994 | CAGCCACA AGAA GGCAGG ACCAGAGAAACACACGUUGUGGUACAUUACCUGGUA | 8137 |
| 2653 | AAGCUCU GAU GACCGAAC | 3995 | GUUCGGUC AGAA GAGCUU ACCAGAGAAACACACGUUGUGGUACAUUACCUGGUA | 8138 |
| 2743 | GGCCUCU GAU GGUGAUCG | 3996 | CGAUCACC AGAA GAGGCC ACCAGAGAAACACACGUUGUGGUACAUUACCUGGUA | 8139 |
| 2779 | GAAACCU GUC CAACUACC | 3997 | GGUAGUUG AGAA GGUUUC ACCAGAGAAACACACGUUGUGGUACAUUACCUGGUA | 8140 |
| 2814 | UUAUUCU GUC UCAACAAG | 3998 | CUUGUUGA AGAA GAAUAA ACCAGAGAAACACACGUUGUGGUACAUUACCUGGUA | 8141 |
| 2831 | GGACGCA GCC UUGCAUAU | 3999 | AUAUGCAA AGAA GCGUCC ACCAGAGAAACACACGUUGUGGUACAUUACCUGGUA | 8142 |
| 2895 | AAGCCCC GCC UAGACAGU | 4000 | ACUGUCUA AGAA GGGGCU ACCAGAGAAACACACGUUGUGGUACAUUACCUGGUA | 8143 |
| 2913 | GUCAGCA GCU CAAGUGUC | 4001 | GACACUUG AGAA GCUGAC ACCAGAGAAACACACGUUGUGGUACAUUACCUGGUA | 8144 |
| 2928 | GUCACCA GCU CCAGCUUC | 4002 | GAAGCUGG AGAA GGUGAC ACCAGAGAAACACACGUUGUGGUACAUUACCUGGUA | 8145 |
| 2934 | AGCUCCA GCU UCCCUGAA | 4003 | UUCAGGGA AGAA GGAGCU ACCAGAGAAACACACGUUGUGGUACAUUACCUGGUA | 8146 |
| 3001 | CCAAGCA GCC CCUCACCA | 4004 | UGGUGAGG AGAA GCUUGG ACCAGAGAAACACACGUUGUGGUACAUUACCUGGUA | 8147 |
| 3022 | AAGACCU GAU UUCCUACA | 4005 | UGUAGGAA AGAA GGUCUU ACCAGAGAAACACACGUUGUGGUACAUUACCUGGUA | 8148 |
| 3033 | UCCUACA GUU UCCAAGUG | 4006 | CACUUGGA AGAA GUAGGA ACCAGAGAAACACACGUUGUGGUACAUUACCUGGUA | 8149 |
| 3064 | AGUUUCU GUC CUCCAGAA | 4007 | UUCUGGAG AGAA GAAACU ACCAGAGAAACACACGUUGUGGUACAUUACCUGGUA | 8150 |
| 3179 | GAACCCU GUC UAUGUGAG | 4008 | CUCACAUA AGAA GGGUUC ACCAGAGAAACACACGUUGUGGUACAUUACCUGGUA | 5613 |
| 3357 | UUCUGCA GCC GCCUGAAG | 4009 | CUUCAGGC AGAA GCAGAA ACCAGAGAAACACACGUUGUGGUACAUUACCUGGUA | 8151 |
| 3360 | UGCAGCC GCC UGAGGAA | 4010 | UUCCUUCA AGAA GCUGCA ACCAGAGAAACACACGUUGUGGUACAUUACCUGGUA | 8152 |
| 3379 | GCAUGCG GAU GAGAACCC | 4011 | GGGUUCUC AGAA GCAUGC ACCAGAGAAACACACGUUGUGGUACAUUACCUGGUA | 8153 |
| 3463 | GGCCCCG GUU UGCUGAAC | 4012 | GUUCAGCA AGAA GGGGCC ACCAGAGAAACACACGUUGUGGUACAUUACCUGGUA | 8154 |
| 3496 | GUGACCU GCU UCAAGCCA | 4013 | UGGCUUGA AGAA GGUCAC ACCAGAGAAACACACGUUGUGGUACAUUACCUGGUA | 8155 |
| 3553 | CCAUACU GAC UAGAAACA | 4014 | UGUUUCUA AGAA GUAUGG ACCAGAGAAACACACGUUGUGGUACAUUACCUGGUA | 8156 |
| 3615 | AAGGACG GCU UUGCAGAU | 4015 | AUCUGCAA AGAA GUCCUU ACCAGAGAAACACACGUUGUGGUACAUUACCUGGUA | 8157 |
| 3623 | CUUUGCA GAU CCACAUUU | 4016 | AAAUGUGG AGAA GCAAAG ACCAGAGAAACACACGUUGUGGUACAUUACCUGGUA | 8158 |
| 3650 | AAGCUCU GAU GAUGUGAG | 4017 | CUCACAUC AGAA GAGCUU ACCAGAGAAACACACGUUGUGGUACAUUACCUGGUA | 8159 |
| 3754 | ACUAUCA GCU GGACACUA | 4018 | UAGUGUCC AGAA GAUAGU ACCAGAGAAACACACGUUGUGGUACAUUACCUGGUA | 8160 |
| 3772 | GCACUCU GCU GGGCUCCC | 4019 | GGGAGCCC AGAA GAGUGC ACCAGAGAAACACACGUUGUGGUACAUUACCUGGUA | 8161 |
| 3796 | UGAAGCU GUU CACCUGGA | 4020 | UCCAGGUG AGAA GCUUCA ACCAGAGAAACACACGUUGUGGUACAUUACCUGGUA | 8162 |
| 3881 | ACUUUCC GAU CUGCCGAG | 4021 | CUCGGCAG AGAA GAAAGU ACCAGAGAAACACACGUUGUGGUACAUUACCUGGUA | 8163 |

TABLE IX-continued

Mouse flt1 VEGF Receptor-Hairpin Ribozyme and Substrate Sequence

| Pos | Substrate | Seq ID No | HP Ribozyme | Seq ID No |
|---|---|---|---|---|
| 3886 | CCGAUCU GCC GAGGCCCA | 4022 | UGGGCCUC AGAA GAUCGG ACCAGAGAAACACACGUUGUGGUACAUUACCUGGUA | 8164 |
| 3897 | AGGCCCA GCU UCUGCUUC | 4023 | GAAGCAGA AGAA GGGCCU ACCAGAGAAACACACGUUGUGGUACAUUACCUGGUA | 8165 |
| 3903 | AGCUUCU GCU UCUCCAGC | 4024 | GCUGGAGA AGAA GAAGCU ACCAGAGAAACACACGUUGUGGUACAUUACCUGGUA | 8166 |
| 3912 | UUCUCCA GCU GUGGCCAC | 4025 | GUGGCCAC AGAA GGAGAA ACCAGAGAAACACACGUUGUGGUACAUUACCUGGUA | 8167 |
| 3969 | GAGUCCU GCU GUUCUCCA | 4026 | UGGAGAAC AGAA GGACUC ACCAGAGAAACACACGUUGUGGUACAUUACCUGGUA | 8168 |
| 3972 | UCCUGCU GUU CUCCACCC | 4027 | GGGUGGAG AGAA GCAGGA ACCAGAGAAACACACGUUGUGGUACAUUACCUGGUA | 8169 |
| 3986 | ACCCCCA GAC UACAACUC | 4028 | GAGUUGUA AGAA GGGGGU ACCAGAGAAACACACGUUGUGGUACAUUACCUGGUA | 8170 |
| 4018 | CCUCCCC GCC CGCCUAAA | 4029 | UUUAGGCG AGAA GGGAGG ACCAGAGAAACACACGUUGUGGUACAUUACCUGGUA | 8171 |
| 4022 | CCCGCCC GCC UAAAGCUU | 4030 | AAGCUUUA AGAA GGCGGG ACCAGAGAAACACACGUUGUGGUACAUUACCUGGUA | 8172 |
| 4040 | CUCACCA GCC CCGACAAC | 4031 | GUUGUCGG AGAA GGUGAG ACCAGAGAAACACACGUUGUGGUACAUUACCUGGUA | 8173 |
| 4053 | ACAACCA GCC CCUGACAG | 4032 | CUGUCAGG AGAA GGUUGU ACCAGAGAAACACACGUUGUGGUACAUUACCUGGUA | 8174 |
| 4095 | CUAUUCC GCU CCACAGGA | 4033 | UCCUGUGG AGAA GGAAUAG ACCAGAGAAACACACGUUGUGGUACAUUACCUGGUA | 8175 |
| 4110 | GGAGCCA GCU GCUUUCG | 4034 | CGAAAAGC AGAA GGCUCC ACCAGAGAAACACACGUUGUGGUACAUUACCUGGUA | 8176 |
| 4113 | GCCAGCU GCU UUUCGUGA | 4035 | UCACGAAA AGAA GCUGGC ACCAGAGAAACACACGUUGUGGUACAUUACCUGGUA | 8177 |
| 4168 | UGUUGCU GCU UUGACUAA | 4036 | UUAGUCAA AGAA GCAACA ACCAGAGAAACACACGUUGUGGUACAUUACCUGGUA | 8178 |
| 4290 | GGCGACC GCC CGCCCACC | 4037 | GGUGGGCG AGAA GUCGCC ACCAGAGAAACACACGUUGUGGUACAUUACCUGGUA | 8179 |
| 4294 | ACCGCCC GCC CACCGGCC | 4038 | GGCCGGUG AGAA GGCGGU ACCAGAGAAACACACGUUGUGGUACAUUACCUGGUA | 8180 |
| 4329 | CCCUGCA GCU GUGGGACU | 4039 | AGUCCCAC AGAA GCAGGG ACCAGAGAAACACACGUUGUGGUACAUUACCUGGUA | 8181 |
| 4378 | AUGCACU GAC CUGCUCUG | 4040 | CAGAGCAG AGAA GUGCAU ACCAGAGAAACACACGUUGUGGUACAUUACCUGGUA | 8182 |
| 4383 | CUGACCU GCU CUGUCUCU | 4041 | AGAGACAG AGAA GGUCAG ACCAGAGAAACACACGUUGUGGUACAUUACCUGGUA | 8183 |
| 4388 | CUGCUCU GUC UCUCUUAU | 4042 | AUAAGAGA AGAA GAGCAG ACCAGAGAAACACACGUUGUGGUACAUUACCUGGUA | 8184 |
| 4457 | UGCGUCC GUC CUGUGGAG | 4043 | CUCCACAG AGAA GACGCA ACCAGAGAAACACACGUUGUGGUACAUUACCUGGUA | 8185 |
| 4525 | GGCCUCC GCU GUUUCGGG | 4044 | CCCGAAAC AGAA GAGGCC ACCAGAGAAACACACGUUGUGGUACAUUACCUGGUA | 8186 |
| 4528 | CUCCGCU GCU UCGGGCCC | 4045 | GGGCCCGA AGAA GCGGAG ACCAGAGAAACACACGUUGUGGUACAUUACCUGGUA | 8187 |
| 4643 | GUCUUCU GUU GUCUGUUU | 4046 | AAACAGAC AGAA GAAGAC ACCAGAGAAACACACGUUGUGGUACAUUACCUGGUA | 8188 |
| 4650 | GUUGUCU GUU UACCAUCC | 4047 | GGAUGGUA AGAA GACAAC ACCAGAGAAACACACGUUGUGGUACAUUACCUGGUA | 8189 |
| 4724 | AUCAUCA GUU CCUCUAGU | 4048 | ACUAGAGG AGAA GAUGAU ACCAGAGAAACACACGUUGUGGUACAUUACCUGGUA | 8190 |
| 4771 | CAGGCCU GAC CUUCGCAU | 4049 | AUGCGAAG AGAA GGCCUG ACCAGAGAAACACACGUUGUGGUACAUUACCUGGUA | 8191 |
| 4785 | GCAUACU GCU CACGGGGA | 4050 | UCCCCGUG AGAA GUAUGC ACCAGAGAAACACACGUUGUGGUACAUUACCUGGUA | 8192 |
| 4809 | UGGUCCA GUU UGGCCUAG | 4051 | CUAGGCCA AGAA GGACCA ACCAGAGAAACACACGUUGUGGUACAUUACCUGGUA | 8193 |
| 4834 | GCCUACU GAU GGGCUCAA | 4052 | UUGAGCCC AGAA GUAGGC ACCAGAGAAACACACGUUGUGGUACAUUACCUGGUA | 8194 |
| 4912 | UUAUCCU GUU UUAUAUAU | 4053 | AUAUAUAA AGAA GGAUAA ACCAGAGAAACACACGUUGUGGUACAUUACCUGGUA | 8195 |
| 5119 | CAAGGCA GUC UGAGAGGA | 4054 | UCCUCUCA AGAA GCCUUG ACCAGAGAAACACACGUUGUGGUACAUUACCUGGUA | 8196 |
| 5144 | AGUAUCA GCC CAUAUUUA | 4055 | UAAAUAUG AGAA GAUACU ACCAGAGAAACACACGUUGUGGUACAUUACCUGGUA | 8197 |
| 5287 | UUCAUCU GUU UCAUACCU | 4056 | AGGUAUGA AGAA GAUGAA ACCAGAGAAACACACGUUGUGGUACAUUACCUGGUA | 8198 |
| 5363 | GGUGCCC GCU CUUUGGGG | 4057 | CCCCAAAG AGAA GGCACC ACCAGAGAAACACACGUUGUGGUACAUUACCUGGUA | 8199 |
| 5462 | CACACCU GCC GGAGCCGG | 4058 | CCGGCUCC AGAA GGUGUG ACCAGAGAAACACACGUUGUGGUACAUUACCUGGUA | 8200 |
| 5478 | GGUCACA GCU GGGCAGAC | 4059 | GUCUGCCC AGAA GUGACC ACCAGAGAAACACACGUUGUGGUACAUUACCUGGUA | 8201 |
| 5486 | CUGGGCA GAC GAUGAAUA | 4060 | UAUUCAUC AGAA GCCCAG ACCAGAGAAACACACGUUGUGGUACAUUACCUGGUA | 8202 |
| 5500 | AAUAGCU GCU UUGGGAGA | 4061 | UCUCCCAA AGAA GCUAUU ACCAGAGAAACACACGUUGUGGUACAUUACCUGGUA | 8203 |
| 5539 | AUUCUCU GCU CGGGCCAG | 4062 | CUGGCCCG AGAA GAGAAU ACCAGAGAAACACACGUUGUGGUACAUUACCUGGUA | 8204 |
| 5564 | GGUACCU GCU CCCCUGUG | 4063 | CACAGGGG AGAA GGUACC ACCAGAGAAACACACGUUGUGGUACAUUACCUGGUA | 8205 |
| 5597 | GUUUUCU GUC UGAUGAGA | 4064 | UCUCAUCA AGAA GAAAAC ACCAGAGAAACACACGUUGUGGUACAUUACCUGGUA | 8206 |
| 5601 | UCUGUCU GAU GAGACUGG | 4065 | CCAGUCUC AGAA GACAGA ACCAGAGAAACACACGUUGUGGUACAUUACCUGGUA | 8207 |
| 5639 | UGAGACA GCC UGCAGCCC | 4066 | GGGCUGCA AGAA GUCUCA ACCAGAGAAACACACGUUGUGGUACAUUACCUGGUA | 8208 |
| 5646 | GCCUGCA GCC CACUGUGG | 4067 | CCACAGUG AGAA GCAGGC ACCAGAGAAACACACGUUGUGGUACAUUACCUGGUA | 8209 |
| 5781 | CUUGUCG GCU GCAGUGUG | 4068 | CACACUGC AGAA GACAAG ACCAGAGAAACACACGUUGUGGUACAUUACCUGGUA | 8210 |
| 5829 | AGAAACG GAU GAGAACAG | 4069 | CUGUUCUC AGAA GUUUCU ACCAGAGAAACACACGUUGUGGUACAUUACCUGGUA | 8211 |
| 5842 | AACAGCA GCC UGAGGUUU | 4070 | AAACCUCA AGAA GCUGUU ACCAGAGAAACACACGUUGUGGUACAUUACCUGGUA | 8212 |
| 5915 | UUAUUCC GAU UUUAAUAA | 4071 | UUAUUAAA AGAA GGAAUAA ACCAGAGAAACACACGUUGUGGUACAUUACCUGGUA | 8213 |
| 6010 | UGGUUCU GCU UAAAGACU | 4072 | AGUCUUUA AGAA GAACCA ACCAGAGAAACACACGUUGUGGUACAUUACCUGGUA | 8214 |

TABLE X

Homologous Hammerhead Ribozyme Target Sites Between Human flt-1 and KDR RNA

| nt. Position | flt-1 Target Sequence | Seq ID No | nt. Position | KDR Target Sequence | Seq ID No |
|---|---|---|---|---|---|
| 3388 | CCGGGAU A UUUAUAA | 4073 | 3151 | CCGGGAUAUUUAUAA | 4073 |
| 2174 | AAUGUAU A CACAGGG | 4074 | 3069 | AgUGUAUcCACAGGG | 4116 |
| 2990 | UGCAAAU A UGGAAAU | 4075 | 2756 | UGCAAAUuUGGAAAc | 4117 |
| 2693 | CUCCCUU A UGAUGCC | 4076 | 2459 | CUgCCUUAUGAUGCC | 4118 |
| 2981 | GUUGAAU A CUGCAAA | 4077 | 2747 | GUgGAAUuCUGCAAA | 4119 |
| 1359 | UAUGGUU A AAAGAUG | 4078 | 2097 | UgUGGUUuAAAGAUa | 4120 |
| 3390 | GGGAUAU U UAUAAGA | 4079 | 3153 | GGGAUUUUAUAAag | 4121 |
| 3391 | GGAUAUU U AUAAGAA | 4080 | 3154 | GGAUAUUUAUAAagA | 4122 |
| 2925 | ACGUGGU U AACCUGC | 4081 | 2691 | AuGUGGUcAACCUuC | 4123 |
| 7140 | UAUUUCU A GUCAUGA | 4082 | 2340 | UAcUUCUuGUCAUcA | 4124 |
| 1785 | CAAUAAU A GAAGGAA | 4083 | 1515 | CucUAAUuGAAGGAA | 4125 |
| 2731 | GAGACUU A AACUGGG | 4084 | 768 | uuGACUUcAACUGGG | 4126 |

TABLE X-continued

Homologous Hammerhead Ribozyme Target Sites Between Human flt-1 and KDR RNA

| nt. Position | flt-1 Target Sequence | Seq ID No | nt. Position | KDR Target Sequence | Seq ID No |
|---|---|---|---|---|---|
| 3974 | GAUGACU A CCAGGGC | 4085 | 1466 | GAgGACUuCCAGGGa | 4127 |
| 6590 | UUAAUGU A GAAAGAA | 4086 | 2603 | aaAAUGUuGAAAGAA | 4128 |
| 6705 | GCCAUUU A UGACAAA | 4087 | 3227 | aCaAUUUuUGACAgA | 4129 |
| 974 | GUCAAAU U ACUUAGA | 4088 | 147 | uUCAAAUUACUUgcA | 4130 |
| 1872 | AUAAAGU U GGGACUG | 4089 | 1602 | AcAAAGUcGGGAgaG | 4131 |
| 2333 | ACUUGGU U UAAAAAC | 4090 | 1088 | AaaUGGUaUAAAAAu | 4132 |
| 2775 | AAGUGGU U CAAGCAU | 4091 | 1745 | AcaUGGUaCAAGCuU | 4133 |
| 3533 | UUCUCCU U AGGUGGG | 4092 | 3296 | UUuUCCUUAGGUGcu | 4134 |
| 3534 | UCUCCUU A GGUGGGU | 4093 | 3297 | UUUCCUUAGGUGcuU | 4135 |
| 3625 | GUACUCU A CUCCUGA | 4094 | 4054 | GagCUCUcCUCCUGu | 4136 |
| 1814 | AGCACCU U GGUUGUG | 4095 | 1059 | AGuACCUUGGUUacc | 4137 |
| 2744 | GGCAAAU C ACUUGGA | 4096 | 147 | uuCAAAUuACUUGcA | 4130 |
| 2783 | CAAGCAU C AGCAUUU | 4097 | 796 | gAAGCAUCAGCAUaa | 4138 |
| 3613 | GAGAGCU C CUGAGUA | 4098 | 2968 | GgaAGCUCCUGAagA | 4139 |
| 4052 | AAGGCCU C GCUCAAG | 4099 | 1923 | ucuGCCUuGCUCAAG | 4140 |
| 5305 | UCUCCAU A UCAAAAC | 4100 | 456 | ggUCCAUuUCAAAuC | 4141 |
| 7158 | AUGUAUU U UGUAUAC | 4101 | 631 | gUcUAUUaUGUAcAu | 4142 |
| 1836 | CUAGAAU U UCUGGAA | 4102 | 1007 | aUgGAAUcUCUGGug | 4143 |
| 2565 | CUCUCUU C UGGCUCC | 4103 | 2328 | uguUCUUCUGGCUaC | 4144 |
| 4250 | CUGUACU C CACCCCA | 4104 | 3388 | uUaUACUaCACCagA | 4145 |
| 7124 | ACAUGGU U UGGUCCU | 4105 | 3778 | cagUGGUaUGGUuCU | 4146 |
| 436 | AUGGUCU U UGCCUGA | 4106 | 1337 | AcGGUCUaUGCCauu | 4147 |
| 2234 | GCACCAU A CCUCCUG | 4107 | 1344 | augCCAUuCCUCCcc | 4148 |
| 2763 | GGGCUUU U GGAAAAG | 4108 | 990 | uuGCUUUUGGAAguG | 4149 |
| 4229 | CCAGACU A CAACUCG | 4109 | 767 | auuGACUuCAACUgG | 4150 |
| 5301 | GUUUUCU C CAUAUCA | 4110 | 3307 | ugcUUCUCCAUAUCc | 4151 |
| 6015 | AGAAUGU A UGCCUCU | 4111 | 1917 | AcuAUGUcUGCCUug | 4152 |
| 6095 | AUUCCCU A GUGAGCC | 4112 | 1438 | AUaCCCUuGUGAaga | 4153 |
| 6236 | UGUUGUU C CUCUUCU | 4113 | 76 | UagUGUUcCUCUUga | 4154 |
| 5962 | GCUUCCU U UUAUCCA | 4114 | 3099 | auaUCCUcUUAUCgg | 4155 |
| 7629 | UAUAUAU U CUCUGCU | 4115 | 3096 | gAaAUAUcCUCUuaU | 4156 |

Lowercase letters are used to represent sequence variance between flt-1 and KDR RNA

SEQUENCE LISTING (8231 sequences)

SEQ ID NO: 1 - RNA, 17 nt, Homo sapiens
cggacacuccucucggc

SEQ ID NO: 2 - RNA, 17 nt, Homo sapiens
acacuccucucggcucc

SEQ ID NO: 3 - RNA, 17 nt, Homo sapiens
acuccucucggcuccuc

SEQ ID NO: 4 - RNA, 17 nt, Homo sapiens
ucucggcuccuccccgg

SEQ ID NO: 5 - RNA, 17 nt, Homo sapiens
cggcuccuccccggcag

SEQ ID NO: 6 - RNA, 17 nt, Homo sapiens
cggcggcucggagcggg

SEQ ID NO: 7 - RNA, 17 nt, Homo sapiens
agcgggcuccggggcuc

SEQ ID NO: 8 - RNA, 17 nt, Homo sapiens
ccggggcucgggugcag

SEQ ID NO: 9 - RNA, 17 nt, Homo sapiens
gcgaggauuacccgggg

SEQ ID NO: 10 - RNA, 17 nt, Homo sapiens
cgaggauuacccgggga

SEQ ID NO: 11 - RNA, 17 nt, Homo sapiens
gaagugguugucuccug

SEQ ID NO: 12 - RNA, 17 nt, Homo sapiens
gugguugucuccuggcu

SEQ ID NO: 13 - RNA, 17 nt, Homo sapiens
gguugucuccuggcugg

SEQ ID NO: 14 - RNA, 17 nt, Homo sapiens
cgggcgcucagggcgcg

SEQ ID NO: 15 - RNA, 17 nt, Homo sapiens
gacggacucuggcggcc

SEQ ID NO: 16 - RNA, 17 nt, Homo sapiens
ggccgggucguuggccg

SEQ ID NO: 17 - RNA, 17 nt, Homo sapiens
cgggucguuggccgggg

SEQ ID NO: 18 - RNA, 17 nt, Homo sapiens
ggccgcgucgcgcucac

SEQ ID NO: 19 - RNA, 17 nt, Homo sapiens
gucgcgcucaccauggu

SEQ ID NO: 20 - RNA, 17 nt, Homo sapiens
accauggucagcuacug

SEQ ID NO: 21 - RNA, 17 nt, Homo sapiens
ggucagcuacugggaca

SEQ ID NO: 22 - RNA, 17 nt, Homo sapiens
accgggguccugcugug

SEQ ID NO: 23 - RNA, 17 nt, Homo sapiens
gcgcugcucagcugucu

SEQ ID NO: 24 - RNA, 17 nt, Homo sapiens
ucagcugucugcuucuc

SEQ ID NO: 25 - RNA, 17 nt, Homo sapiens
ugucugcuucucacagg

SEQ ID NO: 26 - RNA, 17 nt, Homo sapiens
gucugcuucucacagga

SEQ ID NO: 27 - RNA, 17 nt, Homo sapiens
cugcuucucacaggauc

SEQ ID NO: 28 - RNA, 17 nt, Homo sapiens
cacaggaucuaguucag

SEQ ID NO: 29 - RNA, 17 nt, Homo sapiens
caggaucuaguucaggu

SEQ ID NO: 30 - RNA, 17 nt, Homo sapiens
gaucuaguucagguuca

SEQ ID NO: 31 - RNA, 17 nt, Homo sapiens
aucuaguucagguucaa

SEQ ID NO: 32 - RNA, 17 nt, Homo sapiens
guucagguucaaaauua

SEQ ID NO: 33 - RNA, 17 nt, Homo sapiens
uucagguucaaaauuaa

SEQ ID NO: 34 - RNA, 17 nt, Homo sapiens
uucaaaauuaaaagauc

SEQ ID NO: 35 - RNA, 17 nt, Homo sapiens
ucaaaauuaaaagaucc

SEQ ID NO: 36 - RNA, 17 nt, Homo sapiens
uaaaagauccugaacug

SEQ ID NO: 37 - RNA, 17 nt, Homo sapiens
aacugaguuuaaaaggc

SEQ ID NO: 38 - RNA, 17 nt, Homo sapiens
acugaguuuaaaaggca

SEQ ID NO: 39 - RNA, 17 nt, Homo sapiens
cugaguuuaaaaggcac

SEQ ID NO: 40 - RNA, 17 nt, Homo sapiens
cagcacaucaugcaagc

SEQ ID NO: 41 - RNA, 17 nt, Homo sapiens
cacugcaucuccaaugc

SEQ ID NO: 42 - RNA, 17 nt, Homo sapiens
cugcaucuccaaugcag

SEQ ID NO: 43 - RNA, 17 nt, Homo sapiens
cagcccauaaauggucu

SEQ ID NO: 44 - RNA, 17 nt, Homo sapiens
uaaauggucuuugccug

SEQ ID NO: 45 - RNA, 17 nt, Homo sapiens
aauggucuuugccugaa

SEQ ID NO: 46 - RNA, 17 nt, Homo sapiens
auggucuuugccugaaa

SEQ ID NO: 47 - RNA, 17 nt, Homo sapiens
uggugaguaaggaaagc

SEQ ID NO: 48 - RNA, 17 nt, Homo sapiens
cugagcauaacuaaauc

SEQ ID NO: 49 - RNA, 17 nt, Homo sapiens
gcauaacuaaaucugcc

SEQ ID NO: 50 - RNA, 17 nt, Homo sapiens
aacuaaaucugccugug

SEQ ID NO: 51 - RNA, 17 nt, Homo sapiens
caaacaauucugcagua

SEQ ID NO: 52 - RNA, 17 nt, Homo sapiens
aaacaauucugcaguac

SEQ ID NO: 53 - RNA, 17 nt, Homo sapiens
ucugcaguacuuuaacc

SEQ ID NO: 54 - RNA, 17 nt, Homo sapiens
gcaguacuuuaaccuug

SEQ ID NO: 55 - RNA, 17 nt, Homo sapiens
caguacuuuaaccuuga

SEQ ID NO: 56 - RNA, 17 nt, Homo sapiens
aguacuuuaaccuugaa

SEQ ID NO: 57 - RNA, 17 nt, Homo sapiens
uuuaaccuugaacacag

SEQ ID NO: 58 - RNA, 17 nt, Homo sapiens
acacagcucaagcaaac

SEQ ID NO: 59 - RNA, 17 nt, Homo sapiens
cacuggcuucuacagcu

SEQ ID NO: 60 - RNA, 17 nt, Homo sapiens
acuggcuucuacagcug

SEQ ID NO: 61 - RNA, 17 nt, Homo sapiens
uggcuucuacagcugca

SEQ ID NO: 62 - RNA, 17 nt, Homo sapiens
cugcaaauaucuagcug

SEQ ID NO: 63 - RNA, 17 nt, Homo sapiens
gcaaauaucuagcugua

SEQ ID NO: 64 - RNA, 17 nt, Homo sapiens
aaauaucuagcuguacc

SEQ ID NO: 65 - RNA, 17 nt, Homo sapiens
cuagcuguaccuacuuc

SEQ ID NO: 66 - RNA, 17 nt, Homo sapiens
cuguaccuacuucaaag

SEQ ID NO: 67 - RNA, 17 nt, Homo sapiens
uaccuacuucaaagaag

SEQ ID NO: 68 - RNA, 17 nt, Homo sapiens
accuacuucaaagaaga

SEQ ID NO: 69 - RNA, 17 nt, Homo sapiens
aacagaaucugcaaucu

SEQ ID NO: 70 - RNA, 17 nt, Homo sapiens
ucugcaaucuauauauu

SEQ ID NO: 71 - RNA, 17 nt, Homo sapiens
ugcaaucuauauauuua

SEQ ID NO: 72 - RNA, 17 nt, Homo sapiens
caaucuauauauuuauu

SEQ ID NO: 73 - RNA, 17 nt, Homo sapiens
aucuauauauuuauuag

SEQ ID NO: 74 - RNA, 17 nt, Homo sapiens
cuauauauuuauuagug

SEQ ID NO: 75 - RNA, 17 nt, Homo sapiens
uauauauuuauuaguga

SEQ ID NO: 76 - RNA, 17 nt, Homo sapiens
auauauuuauuagugau

SEQ ID NO: 77 - RNA, 17 nt, Homo sapiens
auauuuauuagugauac

SEQ ID NO: 78 - RNA, 17 nt, Homo sapiens
uauuuauuagugauaca

SEQ ID NO: 79 - RNA, 17 nt, Homo sapiens
uuagugauacagguaga

SEQ ID NO: 80 - RNA, 17 nt, Homo sapiens
auacagguagaccuuuc

SEQ ID NO: 81 - RNA, 17 nt, Homo sapiens
guagaccuuucguagag

SEQ ID NO: 82 - RNA, 17 nt, Homo sapiens
uagaccuuucguagaga

SEQ ID NO: 83 - RNA, 17 nt, Homo sapiens
agaccuuucguagagau

SEQ ID NO: 84 - RNA, 17 nt, Homo sapiens
ccuuucguagagaugua

SEQ ID NO: 85 - RNA, 17 nt, Homo sapiens
agagauguacagugaaa

SEQ ID NO: 86 - RNA, 17 nt, Homo sapiens
agugaaauccccgaaau

SEQ ID NO: 87 - RNA, 17 nt, Homo sapiens
cccgaaauuauacacau

SEQ ID NO: 88 - RNA, 17 nt, Homo sapiens
ccgaaauuauacacaug

SEQ ID NO: 89 - RNA, 17 nt, Homo sapiens
gaaauuauacacaugac

SEQ ID NO: 90 - RNA, 17 nt, Homo sapiens
agggagcucgucauucc

SEQ ID NO: 91 - RNA, 17 nt, Homo sapiens
gagcucgucauucccug

SEQ ID NO: 92 - RNA, 17 nt, Homo sapiens
cucgucauucccugccg

SEQ ID NO: 93 - RNA, 17 nt, Homo sapiens
ucgucauucccugccgg

SEQ ID NO: 94 - RNA, 17 nt, Homo sapiens
ugccggguuacgucacc

SEQ ID NO: 95 - RNA, 17 nt, Homo sapiens
gccggguuacgucaccu

SEQ ID NO: 96 - RNA, 17 nt, Homo sapiens
gguuacgucaccuaaca

SEQ ID NO: 97 - RNA, 17 nt, Homo sapiens
cgucaccuaacaucacu

SEQ ID NO: 98 - RNA, 17 nt, Homo sapiens
ccuaacaucacuguuac

SEQ ID NO: 99 - RNA, 17 nt, Homo sapiens
aucacuguuacuuuaaa

SEQ ID NO: 100 - RNA, 17 nt, Homo sapiens
ucacuguuacuuuaaaa

SEQ ID NO: 101 - RNA, 17 nt, Homo sapiens
cuguuacuuuaaaaaag

SEQ ID NO: 102 - RNA, 17 nt, Homo sapiens
uguuacuuuaaaaaagu

SEQ ID NO: 103 - RNA, 17 nt, Homo sapiens
guuacuuuaaaaaaguu

SEQ ID NO: 104 - RNA, 17 nt, Homo sapiens
aaaaaaguuuccacuug

SEQ ID NO: 105 - RNA, 17 nt, Homo sapiens
aaaaaguuuccacuuga

SEQ ID NO: 106 - RNA, 17 nt, Homo sapiens
aaaaguuuccacuugac

SEQ ID NO: 107 - RNA, 17 nt, Homo sapiens
uuuccacuugacacuuu

SEQ ID NO: 108 - RNA, 17 nt, Homo sapiens
uugacacuuugaucccu

SEQ ID NO: 109 - RNA, 17 nt, Homo sapiens
ugacacuuugaucccug

SEQ ID NO: 110 - RNA, 17 nt, Homo sapiens
acuuugaucccugaugg

SEQ ID NO: 111 - RNA, 17 nt, Homo sapiens
aaacgcauaaucuggga

SEQ ID NO: 112 - RNA, 17 nt, Homo sapiens
cgcauaaucugggacag

SEQ ID NO: 113 - RNA, 17 nt, Homo sapiens
gggacaguagaaagggc

SEQ ID NO: 114 - RNA, 17 nt, Homo sapiens
aaagggcuucaucauau

SEQ ID NO: 115 - RNA, 17 nt, Homo sapiens
aagggcuucaucauauc

SEQ ID NO: 116 - RNA, 17 nt, Homo sapiens
ggcuucaucauaucaaa

SEQ ID NO: 117 - RNA, 17 nt, Homo sapiens
uucaucauaucaaaugc

SEQ ID NO: 118 - RNA, 17 nt, Homo sapiens
caucauaucaaaugcaa

SEQ ID NO: 119 - RNA, 17 nt, Homo sapiens
ugcaacguacaaagaaa

SEQ ID NO: 120 - RNA, 17 nt, Homo sapiens
aaagaaauagggcuucu

SEQ ID NO: 121 - RNA, 17 nt, Homo sapiens
auagggcuucugaccug

SEQ ID NO: 122 - RNA, 17 nt, Homo sapiens
uagggcuucugaccugu

SEQ ID NO: 123 - RNA, 17 nt, Homo sapiens
gcaacagucaaugggca

SEQ ID NO: 124 - RNA, 17 nt, Homo sapiens
augggcauuuguauaag

SEQ ID NO: 125 - RNA, 17 nt, Homo sapiens
ugggcauuuguauaaga

SEQ ID NO: 126 - RNA, 17 nt, Homo sapiens
gcauuuguauaagacaa

SEQ ID NO: 127 - RNA, 17 nt, Homo sapiens
auuuguauaagacaaac

SEQ ID NO: 128 - RNA, 17 nt, Homo sapiens
gacaaacuaucucacac

SEQ ID NO: 129 - RNA, 17 nt, Homo sapiens
caaacuaucucacacau

SEQ ID NO: 130 - RNA, 17 nt, Homo sapiens
aacuaucucacacaucg

SEQ ID NO: 131 - RNA, 17 nt, Homo sapiens
ucacacaucgacaaacc

SEQ ID NO: 132 - RNA, 17 nt, Homo sapiens
aaaccaauacaaucaua

SEQ ID NO: 133 - RNA, 17 nt, Homo sapiens
aauacaaucauagaugu

SEQ ID NO: 134 - RNA, 17 nt, Homo sapiens
acaaucauagaugucca

SEQ ID NO: 135 - RNA, 17 nt, Homo sapiens
auagauguccaaauaag

SEQ ID NO: 136 - RNA, 17 nt, Homo sapiens
guccaaauaagcacacc

SEQ ID NO: 137 - RNA, 17 nt, Homo sapiens
cgcccagucaaauuacu

SEQ ID NO: 138 - RNA, 17 nt, Homo sapiens
agucaaauuacuuagag

SEQ ID NO: 139 - RNA, 17 nt, Homo sapiens
gucaaauuacuuagagg

SEQ ID NO: 140 - RNA, 17 nt, Homo sapiens
aaauuacuuagaggcca

SEQ ID NO: 141 - RNA, 17 nt, Homo sapiens
aauuacuuagaggccau

SEQ ID NO: 142 - RNA, 17 nt, Homo sapiens
gaggccauacucuuguc

SEQ ID NO: 143 - RNA, 17 nt, Homo sapiens
gccauacucuuguccuc

SEQ ID NO: 144 - RNA, 17 nt, Homo sapiens
cauacucuuguccucaa

SEQ ID NO: 145 - RNA, 17 nt, Homo sapiens
acucuuguccucaauug

SEQ ID NO: 146 - RNA, 17 nt, Homo sapiens
cuuguccucaauuguac

SEQ ID NO: 147 - RNA, 17 nt, Homo sapiens
uccucaauuguacugcu

SEQ ID NO: 148 - RNA, 17 nt, Homo sapiens
ucaauuguacugcuacc

SEQ ID NO: 149 - RNA, 17 nt, Homo sapiens
guacugcuaccacuccc

SEQ ID NO: 150 - RNA, 17 nt, Homo sapiens
cuaccacucccuugaac

SEQ ID NO: 151 - RNA, 17 nt, Homo sapiens
cacucccuugaacacga

SEQ ID NO: 152 - RNA, 17 nt, Homo sapiens
acgagaguucaaaugac

SEQ ID NO: 153 - RNA, 17 nt, Homo sapiens
cgagaguucaaaugacc

SEQ ID NO: 154 - RNA, 17 nt, Homo sapiens
ccuggaguuacccugau

SEQ ID NO: 155 - RNA, 17 nt, Homo sapiens
cuggaguuacccugaug

SEQ ID NO: 156 - RNA, 17 nt, Homo sapiens
aaaaaaauaagagagcu

SEQ ID NO: 157 - RNA, 17 nt, Homo sapiens
agagagcuuccguaagg

SEQ ID NO: 158 - RNA, 17 nt, Homo sapiens
gagagcuuccguaaggc

SEQ ID NO: 159 - RNA, 17 nt, Homo sapiens
gcuuccguaaggcgacg

SEQ ID NO: 160 - RNA, 17 nt, Homo sapiens
cgacgaauugaccaaag

SEQ ID NO: 161 - RNA, 17 nt, Homo sapiens
aaagcaauucccaugcc

SEQ ID NO: 162 - RNA, 17 nt, Homo sapiens
aagcaauucccaugcca

SEQ ID NO: 163 - RNA, 17 nt, Homo sapiens
gccaacauauucuacag

SEQ ID NO: 164 - RNA, 17 nt, Homo sapiens
caacauauucuacagug

SEQ ID NO: 165 - RNA, 17 nt, Homo sapiens
aacauauucuacagugu

SEQ ID NO: 166 - RNA, 17 nt, Homo sapiens
cauauucuacaguguuc

SEQ ID NO: 167 - RNA, 17 nt, Homo sapiens
uacaguguucuuacuau

SEQ ID NO: 168 - RNA, 17 nt, Homo sapiens
acaguguucuuacuauu

SEQ ID NO: 169 - RNA, 17 nt, Homo sapiens
aguguucuuacuauuga

SEQ ID NO: 170 - RNA, 17 nt, Homo sapiens
guguucuuacuauugac

SEQ ID NO: 171 - RNA, 17 nt, Homo sapiens
uucuuacuauugacaaa

SEQ ID NO: 172 - RNA, 17 nt, Homo sapiens
cuuacuauugacaaaau

SEQ ID NO: 173 - RNA, 17 nt, Homo sapiens
aaaggacuuuauacuug

SEQ ID NO: 174 - RNA, 17 nt, Homo sapiens
aaggacuuuauacuugu

SEQ ID NO: 175 - RNA, 17 nt, Homo sapiens
aggacuuuauacuuguc

SEQ ID NO: 176 - RNA, 17 nt, Homo sapiens
gacuuuauacuugucgu

SEQ ID NO: 177 - RNA, 17 nt, Homo sapiens
uuuauacuugucgugua

SEQ ID NO: 178 - RNA, 17 nt, Homo sapiens
auacuugucguguaagg

SEQ ID NO: 179 - RNA, 17 nt, Homo sapiens
ugucguguaaggagugg

SEQ ID NO: 180 - RNA, 17 nt, Homo sapiens
uggaccaucauucaaau

SEQ ID NO: 181 - RNA, 17 nt, Homo sapiens
accaucauucaaaucug

SEQ ID NO: 182 - RNA, 17 nt, Homo sapiens
ccaucauucaaaucugu

SEQ ID NO: 183 - RNA, 17 nt, Homo sapiens
auucaaaucuguuaaca

SEQ ID NO: 184 - RNA, 17 nt, Homo sapiens
aaaucuguuaacaccuc

SEQ ID NO: 185 - RNA, 17 nt, Homo sapiens
aaucuguuaacaccuca

SEQ ID NO: 186 - RNA, 17 nt, Homo sapiens
uaacaccucagugcaua

SEQ ID NO: 187 - RNA, 17 nt, Homo sapiens
cagugcauauauaugau

SEQ ID NO: 188 - RNA, 17 nt, Homo sapiens
gugcauauauaugauaa

SEQ ID NO: 189 - RNA, 17 nt, Homo sapiens
gcauauauaugauaaag

SEQ ID NO: 190 - RNA, 17 nt, Homo sapiens
uauaugauaaagcauuc

SEQ ID NO: 191 - RNA, 17 nt, Homo sapiens
uaaagcauucaucacug

SEQ ID NO: 192 - RNA, 17 nt, Homo sapiens
aaagcauucaucacugu

SEQ ID NO: 193 - RNA, 17 nt, Homo sapiens
gcauucaucacugugaa

SEQ ID NO: 194 - RNA, 17 nt, Homo sapiens
ugaaacaucgaaaacag

SEQ ID NO: 195 - RNA, 17 nt, Homo sapiens
caggugcuugaaaccgu

SEQ ID NO: 196 - RNA, 17 nt, Homo sapiens
gaaaccguagcuggcaa

SEQ ID NO: 197 - RNA, 17 nt, Homo sapiens
caagcggucuuaccggc

SEQ ID NO: 198 - RNA, 17 nt, Homo sapiens
agcggucuuaccggcuc

SEQ ID NO: 199 - RNA, 17 nt, Homo sapiens
gcggucuuaccggcucu

SEQ ID NO: 200 - RNA, 17 nt, Homo sapiens
uaccggcucucuaugaa

SEQ ID NO: 201 - RNA, 17 nt, Homo sapiens
ccggcucucuaugaaag

SEQ ID NO: 202 - RNA, 17 nt, Homo sapiens
ggcucucuaugaaagug

SEQ ID NO: 203 - RNA, 17 nt, Homo sapiens
gaaggcauuucccucgc

SEQ ID NO: 204 - RNA, 17 nt, Homo sapiens
aaggcauuucccucgcc

SEQ ID NO: 205 - RNA, 17 nt, Homo sapiens
aggcauuucccucgccg

SEQ ID NO: 206 - RNA, 17 nt, Homo sapiens
auuucccucgccggaag

SEQ ID NO: 207 - RNA, 17 nt, Homo sapiens
ccggaaguuguaugguu

SEQ ID NO: 208 - RNA, 17 nt, Homo sapiens
gaaguuguaugguuaaa

SEQ ID NO: 209 - RNA, 17 nt, Homo sapiens
uguaugguuaaaagaug

SEQ ID NO: 210 - RNA, 17 nt, Homo sapiens
guaugguuaaaagaugg

SEQ ID NO: 211 - RNA, 17 nt, Homo sapiens
agauggguuaccugcga

SEQ ID NO: 212 - RNA, 17 nt, Homo sapiens
gauggguuaccugcgac

SEQ ID NO: 213 - RNA, 17 nt, Homo sapiens
ugagaaaucugcucgcu

SEQ ID NO: 214 - RNA, 17 nt, Homo sapiens
aaucugcucgcuauuug

SEQ ID NO: 215 - RNA, 17 nt, Homo sapiens
ugcucgcuauuugacuc

SEQ ID NO: 216 - RNA, 17 nt, Homo sapiens
cucgcuauuugacucgu

SEQ ID NO: 217 - RNA, 17 nt, Homo sapiens
ucgcuauuugacucgug

SEQ ID NO: 218 - RNA, 17 nt, Homo sapiens
auuugacucguggcuac

SEQ ID NO: 219 - RNA, 17 nt, Homo sapiens
ucguggcuacucguuaa

SEQ ID NO: 220 - RNA, 17 nt, Homo sapiens
uggcuacucguuaauua

SEQ ID NO: 221 - RNA, 17 nt, Homo sapiens
cuacucguuaauuauca

SEQ ID NO: 222 - RNA, 17 nt, Homo sapiens
uacucguuaauuaucaa

SEQ ID NO: 223 - RNA, 17 nt, Homo sapiens
ucguuaauuaucaagga

SEQ ID NO: 224 - RNA, 17 nt, Homo sapiens
cguuaauuaucaaggac

SEQ ID NO: 225 - RNA, 17 nt, Homo sapiens
uuaauuaucaaggacgu

SEQ ID NO: 226 - RNA, 17 nt, Homo sapiens
aaggacguaacugaaga

SEQ ID NO: 227 - RNA, 17 nt, Homo sapiens
cagggaauuauacaauc

SEQ ID NO: 228 - RNA, 17 nt, Homo sapiens
agggaauuauacaaucu

SEQ ID NO: 229 - RNA, 17 nt, Homo sapiens
ggaauuauacaaucuug

SEQ ID NO: 230 - RNA, 17 nt, Homo sapiens
uauacaaucuugcugag

SEQ ID NO: 231 - RNA, 17 nt, Homo sapiens
uacaaucuugcugagca

SEQ ID NO: 232 - RNA, 17 nt, Homo sapiens
cugagcauaaaacaguc

SEQ ID NO: 233 - RNA, 17 nt, Homo sapiens
aaaacagucaaaugugu

SEQ ID NO: 234 - RNA, 17 nt, Homo sapiens
aaauguguuuaaaaacc

SEQ ID NO: 235 - RNA, 17 nt, Homo sapiens
aauguguuuaaaaaccu

SEQ ID NO: 236 - RNA, 17 nt, Homo sapiens
auguguuuaaaaaccuc

SEQ ID NO: 237 - RNA, 17 nt, Homo sapiens
aaaaaccucacugccac

SEQ ID NO: 238 - RNA, 17 nt, Homo sapiens
cugccacucuaauuguc

SEQ ID NO: 239 - RNA, 17 nt, Homo sapiens
gccacucuaauugucaa

SEQ ID NO: 240 - RNA, 17 nt, Homo sapiens
acucuaauugucaaugu

SEQ ID NO: 241 - RNA, 17 nt, Homo sapiens
cuaauugucaaugugaa

SEQ ID NO: 242 - RNA, 17 nt, Homo sapiens
ccccagauuuacgaaaa

SEQ ID NO: 243 - RNA, 17 nt, Homo sapiens
cccagauuuacgaaaag

SEQ ID NO: 244 - RNA, 17 nt, Homo sapiens
ccagauuuacgaaaagg

SEQ ID NO: 245 - RNA, 17 nt, Homo sapiens
ggccgugucaucguuuc

SEQ ID NO: 246 - RNA, 17 nt, Homo sapiens
cgugucaucguuuccag

SEQ ID NO: 247 - RNA, 17 nt, Homo sapiens
gucaucguuuccagacc

SEQ ID NO: 248 - RNA, 17 nt, Homo sapiens
ucaucguuuccagaccc

SEQ ID NO: 249 - RNA, 17 nt, Homo sapiens
caucguuuccagacccg

SEQ ID NO: 250 - RNA, 17 nt, Homo sapiens
acccggcucucuaccca

SEQ ID NO: 251 - RNA, 17 nt, Homo sapiens
ccggcucucuacccacu

SEQ ID NO: 252 - RNA, 17 nt, Homo sapiens
ggcucucuacccacugg

SEQ ID NO: 253 - RNA, 17 nt, Homo sapiens
agacaaauccugacuug

SEQ ID NO: 254 - RNA, 17 nt, Homo sapiens
uccugacuuguaccgca

SEQ ID NO: 255 - RNA, 17 nt, Homo sapiens
ugacuuguaccgcauau

SEQ ID NO: 256 - RNA, 17 nt, Homo sapiens
uaccgcauaugguaucc

SEQ ID NO: 257 - RNA, 17 nt, Homo sapiens
cauaugguaucccucaa

SEQ ID NO: 258 - RNA, 17 nt, Homo sapiens
uaugguaucccucaacc

SEQ ID NO: 259 - RNA, 17 nt, Homo sapiens
guaucccucaaccuaca

SEQ ID NO: 260 - RNA, 17 nt, Homo sapiens
cucaaccuacaaucaag

SEQ ID NO: 261 - RNA, 17 nt, Homo sapiens
ccuacaaucaagugguu

SEQ ID NO: 262 - RNA, 17 nt, Homo sapiens
caagugguucuggcacc

SEQ ID NO: 263 - RNA, 17 nt, Homo sapiens
aagugguucuggcaccc

SEQ ID NO: 264 - RNA, 17 nt, Homo sapiens
accccuguaaccauaau

SEQ ID NO: 265 - RNA, 17 nt, Homo sapiens
guaaccauaaucauucc

SEQ ID NO: 266 - RNA, 17 nt, Homo sapiens
accauaaucauuccgaa

SEQ ID NO: 267 - RNA, 17 nt, Homo sapiens
auaaucauuccgaagca

SEQ ID NO: 268 - RNA, 17 nt, Homo sapiens
uaaucauuccgaagcaa

SEQ ID NO: 269 - RNA, 17 nt, Homo sapiens
gugugacuuuuguucca

SEQ ID NO: 270 - RNA, 17 nt, Homo sapiens
ugugacuuuuguuccaa

SEQ ID NO: 271 - RNA, 17 nt, Homo sapiens
gugacuuuuguuccaau

SEQ ID NO: 272 - RNA, 17 nt, Homo sapiens
acuuuuguuccaauaau

SEQ ID NO: 273 - RNA, 17 nt, Homo sapiens
cuuuuguuccaauaaug

SEQ ID NO: 274 - RNA, 17 nt, Homo sapiens
guuccaauaaugaagag

SEQ ID NO: 275 - RNA, 17 nt, Homo sapiens
ugaagaguccuuuaucc

SEQ ID NO: 276 - RNA, 17 nt, Homo sapiens
agaguccuuuauccugg

SEQ ID NO: 277 - RNA, 17 nt, Homo sapiens
gaguccuuuauccugga

SEQ ID NO: 278 - RNA, 17 nt, Homo sapiens
aguccuuuauccuggau

SEQ ID NO: 279 - RNA, 17 nt, Homo sapiens
uccuuuauccuggaugc

SEQ ID NO: 280 - RNA, 17 nt, Homo sapiens
aacagaauugagagcau

SEQ ID NO: 281 - RNA, 17 nt, Homo sapiens
gagagcaucacucagcg

SEQ ID NO: 282 - RNA, 17 nt, Homo sapiens
gcaucacucagcgcaug

SEQ ID NO: 283 - RNA, 17 nt, Homo sapiens
auggcaauaauagaagg

SEQ ID NO: 284 - RNA, 17 nt, Homo sapiens
gcaauaauagaaggaaa

SEQ ID NO: 285 - RNA, 17 nt, Homo sapiens
gaaagaauaagauggcu

SEQ ID NO: 286 - RNA, 17 nt, Homo sapiens
agauggcuagcaccuug

SEQ ID NO: 287 - RNA, 17 nt, Homo sapiens
uagcaccuugguugugg

SEQ ID NO: 288 - RNA, 17 nt, Homo sapiens
accuugguuguggcuga

SEQ ID NO: 289 - RNA, 17 nt, Homo sapiens
ggcugacucuagaauuu

SEQ ID NO: 290 - RNA, 17 nt, Homo sapiens
cugacucuagaauuucu

SEQ ID NO: 291 - RNA, 17 nt, Homo sapiens
ucuagaauuucuggaau

SEQ ID NO: 292 - RNA, 17 nt, Homo sapiens
cuagaauuucuggaauc

SEQ ID NO: 293 - RNA, 17 nt, Homo sapiens
uagaauuucuggaaucu

SEQ ID NO: 294 - RNA, 17 nt, Homo sapiens
ucuggaaucuacauuug

SEQ ID NO: 295 - RNA, 17 nt, Homo sapiens
uggaaucuacauuugca

SEQ ID NO: 296 - RNA, 17 nt, Homo sapiens
aucuacauuugcauagc

SEQ ID NO: 297 - RNA, 17 nt, Homo sapiens
ucuacauuugcauagcu

SEQ ID NO: 298 - RNA, 17 nt, Homo sapiens
auuugcauagcuuccaa

SEQ ID NO: 299 - RNA, 17 nt, Homo sapiens
gcauagcuuccaauaaa

SEQ ID NO: 300 - RNA, 17 nt, Homo sapiens
cauagcuuccaauaaag

SEQ ID NO: 301 - RNA, 17 nt, Homo sapiens
cuuccaauaaaguuggg

SEQ ID NO: 302 - RNA, 17 nt, Homo sapiens
aauaaaguugggacugu

SEQ ID NO: 303 - RNA, 17 nt, Homo sapiens
agaaacauaagcuuuua

SEQ ID NO: 304 - RNA, 17 nt, Homo sapiens
cauaagcuuuuauauca

SEQ ID NO: 305 - RNA, 17 nt, Homo sapiens
auaagcuuuuauaucac

SEQ ID NO: 306 - RNA, 17 nt, Homo sapiens
uaagcuuuuauaucaca

SEQ ID NO: 307 - RNA, 17 nt, Homo sapiens
aagcuuuuauaucacag

SEQ ID NO: 308 - RNA, 17 nt, Homo sapiens
gcuuuuauaucacagau

SEQ ID NO: 309 - RNA, 17 nt, Homo sapiens
uuuuauaucacagaugu

SEQ ID NO: 310 - RNA, 17 nt, Homo sapiens
aaauggguuucauguua

SEQ ID NO: 311 - RNA, 17 nt, Homo sapiens
aauggguuucauguuaa

SEQ ID NO: 312 - RNA, 17 nt, Homo sapiens
auggguuucauguuaac

SEQ ID NO: 313 - RNA, 17 nt, Homo sapiens
uuucauguuaacuugga

SEQ ID NO: 314 - RNA, 17 nt, Homo sapiens
uucauguuaacuuggaa

SEQ ID NO: 315 - RNA, 17 nt, Homo sapiens
uguuaacuuggaaaaaa

SEQ ID NO: 316 - RNA, 17 nt, Homo sapiens
gaaacugucuugcacag

SEQ ID NO: 317 - RNA, 17 nt, Homo sapiens
aacugucuugcacaguu

SEQ ID NO: 318 - RNA, 17 nt, Homo sapiens
ugcacaguuaacaaguu

SEQ ID NO: 319 - RNA, 17 nt, Homo sapiens
gcacaguuaacaaguuc

SEQ ID NO: 320 - RNA, 17 nt, Homo sapiens
uaacaaguucuuauaca

SEQ ID NO: 321 - RNA, 17 nt, Homo sapiens
aacaaguucuuauacag

SEQ ID NO: 322 - RNA, 17 nt, Homo sapiens
caaguucuuauacagag

SEQ ID NO: 323 - RNA, 17 nt, Homo sapiens
aaguucuuauacagaga

SEQ ID NO: 324 - RNA, 17 nt, Homo sapiens
guucuuauacagagacg

SEQ ID NO: 325 - RNA, 17 nt, Homo sapiens
agagacguuacuuggau

SEQ ID NO: 326 - RNA, 17 nt, Homo sapiens
gagacguuacuuggauu

SEQ ID NO: 327 - RNA, 17 nt, Homo sapiens
acguuacuuggauuuua

SEQ ID NO: 328 - RNA, 17 nt, Homo sapiens
acuuggauuuuacugcg

SEQ ID NO: 329 - RNA, 17 nt, Homo sapiens
cuuggauuuuacugcgg

SEQ ID NO: 330 - RNA, 17 nt, Homo sapiens
uuggauuuuacugcgga

SEQ ID NO: 331 - RNA, 17 nt, Homo sapiens
uggauuuuacugcggac

SEQ ID NO: 332 - RNA, 17 nt, Homo sapiens
cggacaguuaauaacag

SEQ ID NO: 333 - RNA, 17 nt, Homo sapiens
ggacaguuaauaacaga

SEQ ID NO: 334 - RNA, 17 nt, Homo sapiens
caguuaauaacagaaca

SEQ ID NO: 335 - RNA, 17 nt, Homo sapiens
aaugcacuacaguauua

SEQ ID NO: 336 - RNA, 17 nt, Homo sapiens
acuacaguauuagcaag

SEQ ID NO: 337 - RNA, 17 nt, Homo sapiens
uacaguauuagcaagca

SEQ ID NO: 338 - RNA, 17 nt, Homo sapiens
acaguauuagcaagcaa

SEQ ID NO: 339 - RNA, 17 nt, Homo sapiens
auggccaucacuaagga

SEQ ID NO: 340 - RNA, 17 nt, Homo sapiens
ccaucacuaaggagcac

SEQ ID NO: 341 - RNA, 17 nt, Homo sapiens
ggagcacuccaucacuc

SEQ ID NO: 342 - RNA, 17 nt, Homo sapiens
cacuccaucacucuuaa

SEQ ID NO: 343 - RNA, 17 nt, Homo sapiens
ccaucacucuuaaucuu

SEQ ID NO: 344 - RNA, 17 nt, Homo sapiens
aucacucuuaaucuuac

SEQ ID NO: 345 - RNA, 17 nt, Homo sapiens
ucacucuuaaucuuacc

SEQ ID NO: 346 - RNA, 17 nt, Homo sapiens
cucuuaaucuuaccauc

SEQ ID NO: 347 - RNA, 17 nt, Homo sapiens
cuuaaucuuaccaucau

SEQ ID NO: 348 - RNA, 17 nt, Homo sapiens
uuaaucuuaccaucaug

SEQ ID NO: 349 - RNA, 17 nt, Homo sapiens
cuuaccaucaugaaugu

SEQ ID NO: 350 - RNA, 17 nt, Homo sapiens
augaauguuucccugca

SEQ ID NO: 351 - RNA, 17 nt, Homo sapiens
ugaauguuucccugcaa

SEQ ID NO: 352 - RNA, 17 nt, Homo sapiens
gaauguuucccugcaag

SEQ ID NO: 353 - RNA, 17 nt, Homo sapiens
ugcaagauucaggcacc

SEQ ID NO: 354 - RNA, 17 nt, Homo sapiens
gcaagauucaggcaccu

SEQ ID NO: 355 - RNA, 17 nt, Homo sapiens
aggcaccuaugccugca

SEQ ID NO: 356 - RNA, 17 nt, Homo sapiens
aggaauguauacacagg

SEQ ID NO: 357 - RNA, 17 nt, Homo sapiens
gaauguauacacagggg

SEQ ID NO: 358 - RNA, 17 nt, Homo sapiens
gaagaaauccuccagaa

SEQ ID NO: 359 - RNA, 17 nt, Homo sapiens
gaaauccuccagaagaa

SEQ ID NO: 360 - RNA, 17 nt, Homo sapiens
aaagaaauuacaaucag

SEQ ID NO: 361 - RNA, 17 nt, Homo sapiens
aagaaauuacaaucaga

SEQ ID NO: 362 - RNA, 17 nt, Homo sapiens
auuacaaucagagauca

SEQ ID NO: 363 - RNA, 17 nt, Homo sapiens
ucagagaucaggaagca

SEQ ID NO: 364 - RNA, 17 nt, Homo sapiens
agcaccauaccuccugc

SEQ ID NO: 365 - RNA, 17 nt, Homo sapiens
ccauaccuccugcgaaa

SEQ ID NO: 366 - RNA, 17 nt, Homo sapiens
cgaaaccucagugauca

SEQ ID NO: 367 - RNA, 17 nt, Homo sapiens
ucagugaucacacagug

SEQ ID NO: 368 - RNA, 17 nt, Homo sapiens
guggccaucagcaguuc

SEQ ID NO: 369 - RNA, 17 nt, Homo sapiens
ucagcaguuccaccacu

SEQ ID NO: 370 - RNA, 17 nt, Homo sapiens
cagcaguuccaccacuu

SEQ ID NO: 371 - RNA, 17 nt, Homo sapiens
ccaccacuuuagacugu

SEQ ID NO: 372 - RNA, 17 nt, Homo sapiens
caccacuuuagacuguc

SEQ ID NO: 373 - RNA, 17 nt, Homo sapiens
accacuuuagacuguca

SEQ ID NO: 374 - RNA, 17 nt, Homo sapiens
uagacugucaugcuaau

SEQ ID NO: 375 - RNA, 17 nt, Homo sapiens
gucaugcuaaugguguc

SEQ ID NO: 376 - RNA, 17 nt, Homo sapiens
aaugguguccccgagcc

SEQ ID NO: 377 - RNA, 17 nt, Homo sapiens
ccgagccucagaucacu

SEQ ID NO: 378 - RNA, 17 nt, Homo sapiens
ccucagaucacuugguu

SEQ ID NO: 379 - RNA, 17 nt, Homo sapiens
agaucacuugguuuaaa

SEQ ID NO: 380 - RNA, 17 nt, Homo sapiens
cacuugguuuaaaaaca

SEQ ID NO: 381 - RNA, 17 nt, Homo sapiens
acuugguuuaaaaacaa

SEQ ID NO: 382 - RNA, 17 nt, Homo sapiens
cuugguuuaaaaacaac

SEQ ID NO: 383 - RNA, 17 nt, Homo sapiens
cacaaaauacaacaaga

SEQ ID NO: 384 - RNA, 17 nt, Homo sapiens
ccuggaauuauuuuagg

SEQ ID NO: 385 - RNA, 17 nt, Homo sapiens
cuggaauuauuuuagga

SEQ ID NO: 386 - RNA, 17 nt, Homo sapiens
ggaauuauuuuaggacc

SEQ ID NO: 387 - RNA, 17 nt, Homo sapiens
gaauuauuuuaggacca

SEQ ID NO: 388 - RNA, 17 nt, Homo sapiens
aauuauuuuaggaccag

SEQ ID NO: 389 - RNA, 17 nt, Homo sapiens
auuauuuuaggaccagg

SEQ ID NO: 390 - RNA, 17 nt, Homo sapiens
cacgcuguuuauugaaa

SEQ ID NO: 391 - RNA, 17 nt, Homo sapiens
acgcuguuuauugaaag

SEQ ID NO: 392 - RNA, 17 nt, Homo sapiens
cgcuguuuauugaaaga

SEQ ID NO: 393 - RNA, 17 nt, Homo sapiens
cuguuuauugaaagagu

SEQ ID NO: 394 - RNA, 17 nt, Homo sapiens
gaaagagucacagaaga

SEQ ID NO: 395 - RNA, 17 nt, Homo sapiens
gaaggugucuaucacug

SEQ ID NO: 396 - RNA, 17 nt, Homo sapiens
aggugucuaucacugca

SEQ ID NO: 397 - RNA, 17 nt, Homo sapiens
gugucuaucacugcaaa

SEQ ID NO: 398 - RNA, 17 nt, Homo sapiens
gaagggcucuguggaaa

SEQ ID NO: 399 - RNA, 17 nt, Homo sapiens
uggaaaguucagcauac

SEQ ID NO: 400 - RNA, 17 nt, Homo sapiens
ggaaaguucagcauacc

SEQ ID NO: 401 - RNA, 17 nt, Homo sapiens
uucagcauaccucacug

SEQ ID NO: 402 - RNA, 17 nt, Homo sapiens
gcauaccucacuguuca

SEQ ID NO: 403 - RNA, 17 nt, Homo sapiens
cucacuguucaaggaac

SEQ ID NO: 404 - RNA, 17 nt, Homo sapiens
ucacuguucaaggaacc

SEQ ID NO: 405 - RNA, 17 nt, Homo sapiens
aggaaccucggacaagu

SEQ ID NO: 406 - RNA, 17 nt, Homo sapiens
ggacaagucuaaucugg

SEQ ID NO: 407 - RNA, 17 nt, Homo sapiens
acaagucuaaucuggag

SEQ ID NO: 408 - RNA, 17 nt, Homo sapiens
agucuaaucuggagcug

SEQ ID NO: 409 - RNA, 17 nt, Homo sapiens
gagcugaucacucuaac

SEQ ID NO: 410 - RNA, 17 nt, Homo sapiens
ugaucacucuaacaugc

SEQ ID NO: 411 - RNA, 17 nt, Homo sapiens
aucacucuaacaugcac

SEQ ID NO: 412 - RNA, 17 nt, Homo sapiens
cugcgacucucuucugg

SEQ ID NO: 413 - RNA, 17 nt, Homo sapiens
gcgacucucuucuggcu

SEQ ID NO: 414 - RNA, 17 nt, Homo sapiens
gacucucuucuggcucc

SEQ ID NO: 415 - RNA, 17 nt, Homo sapiens
acucucuucuggcuccu

SEQ ID NO: 416 - RNA, 17 nt, Homo sapiens
uucuggcuccuauuaac

SEQ ID NO: 417 - RNA, 17 nt, Homo sapiens
uggcuccuauuaacccu

SEQ ID NO: 418 - RNA, 17 nt, Homo sapiens
gcuccuauuaacccucc

SEQ ID NO: 419 - RNA, 17 nt, Homo sapiens
cuccuauuaacccuccu

SEQ ID NO: 420 - RNA, 17 nt, Homo sapiens
uuaacccuccuuauccg

SEQ ID NO: 421 - RNA, 17 nt, Homo sapiens
acccuccuuauccgaaa

SEQ ID NO: 422 - RNA, 17 nt, Homo sapiens
cccuccuuauccgaaaa

SEQ ID NO: 423 - RNA, 17 nt, Homo sapiens
cuccuuauccgaaaaau

SEQ ID NO: 424 - RNA, 17 nt, Homo sapiens
gaaaaggucuucuucug

SEQ ID NO: 425 - RNA, 17 nt, Homo sapiens
aaaggucuucuucugaa

SEQ ID NO: 426 - RNA, 17 nt, Homo sapiens
aaggucuucuucugaaa

SEQ ID NO: 427 - RNA, 17 nt, Homo sapiens
ggucuucuucugaaaua

SEQ ID NO: 428 - RNA, 17 nt, Homo sapiens
gucuucuucugaaauaa

SEQ ID NO: 429 - RNA, 17 nt, Homo sapiens
ucugaaauaaagacuga

SEQ ID NO: 430 - RNA, 17 nt, Homo sapiens
gacugacuaccuaucaa

SEQ ID NO: 431 - RNA, 17 nt, Homo sapiens
gacuaccuaucaauuau

SEQ ID NO: 432 - RNA, 17 nt, Homo sapiens
cuaccuaucaauuauaa

SEQ ID NO: 433 - RNA, 17 nt, Homo sapiens
cuaucaauuauaaugga

SEQ ID NO: 434 - RNA, 17 nt, Homo sapiens
uaucaauuauaauggac

SEQ ID NO: 435 - RNA, 17 nt, Homo sapiens
ucaauuauaauggaccc

SEQ ID NO: 436 - RNA, 17 nt, Homo sapiens
gaugaaguuccuuugga

SEQ ID NO: 437 - RNA, 17 nt, Homo sapiens
augaaguuccuuuggau

SEQ ID NO: 438 - RNA, 17 nt, Homo sapiens
aaguuccuuuggaugag

SEQ ID NO: 439 - RNA, 17 nt, Homo sapiens
aguuccuuuggaugagc

SEQ ID NO: 440 - RNA, 17 nt, Homo sapiens
gagcggcucccuuauga

SEQ ID NO: 441 - RNA, 17 nt, Homo sapiens
ggcucccuuaugaugcc

SEQ ID NO: 442 - RNA, 17 nt, Homo sapiens
gcucccuuaugaugcca

SEQ ID NO: 443 - RNA, 17 nt, Homo sapiens
gugggaguuugcccggg

SEQ ID NO: 444 - RNA, 17 nt, Homo sapiens
ugggaguuugcccggga

SEQ ID NO: 445 - RNA, 17 nt, Homo sapiens
gagagacuuaaacuggg

SEQ ID NO: 446 - RNA, 17 nt, Homo sapiens
agagacuuaaacugggc

SEQ ID NO: 447 - RNA, 17 nt, Homo sapiens
gggcaaaucacuuggaa

SEQ ID NO: 448 - RNA, 17 nt, Homo sapiens
aaaucacuuggaagagg

SEQ ID NO: 449 - RNA, 17 nt, Homo sapiens
gaggggcuuuuggaaaa

SEQ ID NO: 450 - RNA, 17 nt, Homo sapiens
aggggcuuuuggaaaag

SEQ ID NO: 451 - RNA, 17 nt, Homo sapiens
ggggcuuuuggaaaagu

SEQ ID NO: 452 - RNA, 17 nt, Homo sapiens
aaagugguucaagcauc

SEQ ID NO: 453 - RNA, 17 nt, Homo sapiens
aagugguucaagcauca

SEQ ID NO: 454 - RNA, 17 nt, Homo sapiens
ucaagcaucagcauuug

SEQ ID NO: 455 - RNA, 17 nt, Homo sapiens
aucagcauuuggcauua

SEQ ID NO: 456 - RNA, 17 nt, Homo sapiens
ucagcauuuggcauuaa

SEQ ID NO: 457 - RNA, 17 nt, Homo sapiens
uuuggcauuaagaaauc

SEQ ID NO: 458 - RNA, 17 nt, Homo sapiens
uuggcauuaagaaauca

SEQ ID NO: 459 - RNA, 17 nt, Homo sapiens
uaagaaaucaccuacgu

SEQ ID NO: 460 - RNA, 17 nt, Homo sapiens
aaucaccuacgugccgg

SEQ ID NO: 461 - RNA, 17 nt, Homo sapiens
cagcgaguacaaagcuc

SEQ ID NO: 462 - RNA, 17 nt, Homo sapiens
acaaagcucugaugacu

SEQ ID NO: 463 - RNA, 17 nt, Homo sapiens
acugagcuaaaaaucuu

SEQ ID NO: 464 - RNA, 17 nt, Homo sapiens
cuaaaaaucuugaccca

SEQ ID NO: 465 - RNA, 17 nt, Homo sapiens
aaaaaucuugacccaca

SEQ ID NO: 466 - RNA, 17 nt, Homo sapiens
acccacauuggccacca

SEQ ID NO: 467 - RNA, 17 nt, Homo sapiens
gccaccaucugaacgug

SEQ ID NO: 468 - RNA, 17 nt, Homo sapiens
aacgugguuaaccugcu

SEQ ID NO: 469 - RNA, 17 nt, Homo sapiens
acgugguuaaccugcug

SEQ ID NO: 470 - RNA, 17 nt, Homo sapiens
gagggccucugauggug

SEQ ID NO: 471 - RNA, 17 nt, Homo sapiens
auggugauuguugaaua

SEQ ID NO: 472 - RNA, 17 nt, Homo sapiens
gugauuguugaauacug

SEQ ID NO: 473 - RNA, 17 nt, Homo sapiens
uguugaauacugcaaau

SEQ ID NO: 474 - RNA, 17 nt, Homo sapiens
cugcaaauauggaaauc

SEQ ID NO: 475 - RNA, 17 nt, Homo sapiens
auggaaaucucuccaac

SEQ ID NO: 476 - RNA, 17 nt, Homo sapiens
ggaaaucucuccaacua

SEQ ID NO: 477 - RNA, 17 nt, Homo sapiens
aaaucucuccaacuacc

SEQ ID NO: 478 - RNA, 17 nt, Homo sapiens
cuccaacuaccucaaga

SEQ ID NO: 479 - RNA, 17 nt, Homo sapiens
aacuaccucaagagcaa

SEQ ID NO: 480 - RNA, 17 nt, Homo sapiens
acgugacuuauuuuuuc

SEQ ID NO: 481 - RNA, 17 nt, Homo sapiens
cgugacuuauuuuuucu

SEQ ID NO: 482 - RNA, 17 nt, Homo sapiens
ugacuuauuuuuucuca

SEQ ID NO: 483 - RNA, 17 nt, Homo sapiens
gacuuauuuuuucucaa

SEQ ID NO: 484 - RNA, 17 nt, Homo sapiens
acuuauuuuuucucaac

SEQ ID NO: 485 - RNA, 17 nt, Homo sapiens
cuuauuuuuucucaaca

SEQ ID NO: 486 - RNA, 17 nt, Homo sapiens
uuauuuuuucucaacaa

SEQ ID NO: 487 - RNA, 17 nt, Homo sapiens
uauuuuuucucaacaag

SEQ ID NO: 488 - RNA, 17 nt, Homo sapiens
uuuuuucucaacaagga

SEQ ID NO: 489 - RNA, 17 nt, Homo sapiens
gcagcacuacacaugga

SEQ ID NO: 490 - RNA, 17 nt, Homo sapiens
uggagccuaagaaagaa

SEQ ID NO: 491 - RNA, 17 nt, Homo sapiens
ccaagacuagauagcgu

SEQ ID NO: 492 - RNA, 17 nt, Homo sapiens
gacuagauagcgucacc

SEQ ID NO: 493 - RNA, 17 nt, Homo sapiens
gauagcgucaccagcag

SEQ ID NO: 494 - RNA, 17 nt, Homo sapiens
cgaaagcuuugcgagcu

SEQ ID NO: 495 - RNA, 17 nt, Homo sapiens
gaaagcuuugcgagcuc

SEQ ID NO: 496 - RNA, 17 nt, Homo sapiens
ugcgagcuccggcuuuc

SEQ ID NO: 497 - RNA, 17 nt, Homo sapiens
cuccggcuuucaggaag

SEQ ID NO: 498 - RNA, 17 nt, Homo sapiens
uccggcuuucaggaaga

SEQ ID NO: 499 - RNA, 17 nt, Homo sapiens
ccggcuuucaggaagau

SEQ ID NO: 500 - RNA, 17 nt, Homo sapiens
aggaagauaaaagucug

SEQ ID NO: 501 - RNA, 17 nt, Homo sapiens
auaaaagucugagugau

SEQ ID NO: 502 - RNA, 17 nt, Homo sapiens
agugauguugaggaaga

SEQ ID NO: 503 - RNA, 17 nt, Homo sapiens
aggaggauucugacggu

SEQ ID NO: 504 - RNA, 17 nt, Homo sapiens
ggaggauucugacgguu

SEQ ID NO: 505 - RNA, 17 nt, Homo sapiens
cugacgguuucuacaag

SEQ ID NO: 506 - RNA, 17 nt, Homo sapiens
ugacgguuucuacaagg

SEQ ID NO: 507 - RNA, 17 nt, Homo sapiens
gacgguuucuacaagga

SEQ ID NO: 508 - RNA, 17 nt, Homo sapiens
cgguuucuacaaggagc

SEQ ID NO: 509 - RNA, 17 nt, Homo sapiens
gagcccaucacuaugga

SEQ ID NO: 510 - RNA, 17 nt, Homo sapiens
ccaucacuauggaagau

SEQ ID NO: 511 - RNA, 17 nt, Homo sapiens
uggaagaucugauuucu

SEQ ID NO: 512 - RNA, 17 nt, Homo sapiens
gaucugauuucuuacag

SEQ ID NO: 513 - RNA, 17 nt, Homo sapiens
aucugauuucuuacagu

SEQ ID NO: 514 - RNA, 17 nt, Homo sapiens
ucugauuucuuacaguu

SEQ ID NO: 515 - RNA, 17 nt, Homo sapiens
ugauuucuuacaguuuu

SEQ ID NO: 516 - RNA, 17 nt, Homo sapiens
gauuucuuacaguuuuc

SEQ ID NO: 517 - RNA, 17 nt, Homo sapiens
cuuacaguuuucaagug

SEQ ID NO: 518 - RNA, 17 nt, Homo sapiens
uuacaguuuucaagugg

SEQ ID NO: 519 - RNA, 17 nt, Homo sapiens
uacaguuuucaaguggc

SEQ ID NO: 520 - RNA, 17 nt, Homo sapiens
acaguuuucaaguggcc

SEQ ID NO: 521 - RNA, 17 nt, Homo sapiens
cauggaguuccugucuu

SEQ ID NO: 522 - RNA, 17 nt, Homo sapiens
auggaguuccugucuuc

SEQ ID NO: 523 - RNA, 17 nt, Homo sapiens
guuccugucuuccagaa

SEQ ID NO: 524 - RNA, 17 nt, Homo sapiens
uccugucuuccagaaag

SEQ ID NO: 525 - RNA, 17 nt, Homo sapiens
ccugucuuccagaaagu

SEQ ID NO: 526 - RNA, 17 nt, Homo sapiens
aagugcauucaucggga

SEQ ID NO: 527 - RNA, 17 nt, Homo sapiens
agugcauucaucgggac

SEQ ID NO: 528 - RNA, 17 nt, Homo sapiens
gcauucaucgggaccug

SEQ ID NO: 529 - RNA, 17 nt, Homo sapiens
agaaacauucuuuuauc

SEQ ID NO: 530 - RNA, 17 nt, Homo sapiens
gaaacauucuuuuaucu

SEQ ID NO: 531 - RNA, 17 nt, Homo sapiens
aacauucuuuuaucuga

SEQ ID NO: 532 - RNA, 17 nt, Homo sapiens
acauucuuuuaucugag

SEQ ID NO: 533 - RNA, 17 nt, Homo sapiens
cauucuuuuaucugaga

SEQ ID NO: 534 - RNA, 17 nt, Homo sapiens
auucuuuuaucugagaa

SEQ ID NO: 535 - RNA, 17 nt, Homo sapiens
ucuuuuaucugagaaca

SEQ ID NO: 536 - RNA, 17 nt, Homo sapiens
gugaagauuugugauuu

SEQ ID NO: 537 - RNA, 17 nt, Homo sapiens
ugaagauuugugauuuu

SEQ ID NO: 538 - RNA, 17 nt, Homo sapiens
uuugugauuuuggccuu

SEQ ID NO: 539 - RNA, 17 nt, Homo sapiens
uugugauuuuggccuug

SEQ ID NO: 540 - RNA, 17 nt, Homo sapiens
ugugauuuuggccuugc

SEQ ID NO: 541 - RNA, 17 nt, Homo sapiens
uuuggccuugcccggga

SEQ ID NO: 542 - RNA, 17 nt, Homo sapiens
cccgggauauuuauaag

SEQ ID NO: 543 - RNA, 17 nt, Homo sapiens
cgggauauuuauaagaa

SEQ ID NO: 544 - RNA, 17 nt, Homo sapiens
gggauauuuauaagaac

SEQ ID NO: 545 - RNA, 17 nt, Homo sapiens
ggauauuuauaagaacc

SEQ ID NO: 546 - RNA, 17 nt, Homo sapiens
auauuuauaagaacccc

SEQ ID NO: 547 - RNA, 17 nt, Homo sapiens
accccgauuaugugaga

SEQ ID NO: 548 - RNA, 17 nt, Homo sapiens
ccccgauuaugugagaa

SEQ ID NO: 549 - RNA, 17 nt, Homo sapiens
aaggagauacucgacuu

SEQ ID NO: 550 - RNA, 17 nt, Homo sapiens
gagauacucgacuuccu

SEQ ID NO: 551 - RNA, 17 nt, Homo sapiens
acucgacuuccucugaa

SEQ ID NO: 552 - RNA, 17 nt, Homo sapiens
cucgacuuccucugaaa

SEQ ID NO: 553 - RNA, 17 nt, Homo sapiens
gacuuccucugaaaugg

SEQ ID NO: 554 - RNA, 17 nt, Homo sapiens
ggauggcucccgaaucu

SEQ ID NO: 555 - RNA, 17 nt, Homo sapiens
ucccgaaucuaucuuug

SEQ ID NO: 556 - RNA, 17 nt, Homo sapiens
ccgaaucuaucuuugac

SEQ ID NO: 557 - RNA, 17 nt, Homo sapiens
gaaucuaucuuugacaa

SEQ ID NO: 558 - RNA, 17 nt, Homo sapiens
aucuaucuuugacaaaa

SEQ ID NO: 559 - RNA, 17 nt, Homo sapiens
ucuaucuuugacaaaau

SEQ ID NO: 560 - RNA, 17 nt, Homo sapiens
gacaaaaucuacagcac

SEQ ID NO: 561 - RNA, 17 nt, Homo sapiens
caaaaucuacagcacca

SEQ ID NO: 562 - RNA, 17 nt, Homo sapiens
cguguggucuuacggag

SEQ ID NO: 563 - RNA, 17 nt, Homo sapiens
uguggucuuacggagua

SEQ ID NO: 564 - RNA, 17 nt, Homo sapiens
guggucuuacggaguau

SEQ ID NO: 565 - RNA, 17 nt, Homo sapiens
uacggaguauugcugug

SEQ ID NO: 566 - RNA, 17 nt, Homo sapiens
cggaguauugcuguggg

SEQ ID NO: 567 - RNA, 17 nt, Homo sapiens
ugggaaaucuucuccuu

SEQ ID NO: 568 - RNA, 17 nt, Homo sapiens
ggaaaucuucuccuuag

SEQ ID NO: 569 - RNA, 17 nt, Homo sapiens
gaaaucuucuccuuagg

SEQ ID NO: 570 - RNA, 17 nt, Homo sapiens
aaucuucuccuuaggug

SEQ ID NO: 571 - RNA, 17 nt, Homo sapiens
cuucuccuuaggugggu

SEQ ID NO: 572 - RNA, 17 nt, Homo sapiens
uucuccuuagguggguc

SEQ ID NO: 573 - RNA, 17 nt, Homo sapiens
aggugggucuccauacc

SEQ ID NO: 574 - RNA, 17 nt, Homo sapiens
gugggucuccauaccca

SEQ ID NO: 575 - RNA, 17 nt, Homo sapiens
gucuccauacccaggag

SEQ ID NO: 576 - RNA, 17 nt, Homo sapiens
ccaggaguacaaaugga

SEQ ID NO: 577 - RNA, 17 nt, Homo sapiens
ugaggacuuuugcaguc

SEQ ID NO: 578 - RNA, 17 nt, Homo sapiens
gaggacuuuugcagucg

SEQ ID NO: 579 - RNA, 17 nt, Homo sapiens
aggacuuuugcagucgc

SEQ ID NO: 580 - RNA, 17 nt, Homo sapiens
uuugcagucgccugagg

SEQ ID NO: 581 - RNA, 17 nt, Homo sapiens
ugagagcuccugaguac

SEQ ID NO: 582 - RNA, 17 nt, Homo sapiens
uccugaguacucuacuc

SEQ ID NO: 583 - RNA, 17 nt, Homo sapiens
ugaguacucuacuccug

SEQ ID NO: 584 - RNA, 17 nt, Homo sapiens
aguacucuacuccugaa

SEQ ID NO: 585 - RNA, 17 nt, Homo sapiens
acucuacuccugaaauc

SEQ ID NO: 586 - RNA, 17 nt, Homo sapiens
ccugaaaucuaucagau

SEQ ID NO: 587 - RNA, 17 nt, Homo sapiens
ugaaaucuaucagauca

SEQ ID NO: 588 - RNA, 17 nt, Homo sapiens
aaaucuaucagaucaug

SEQ ID NO: 589 - RNA, 17 nt, Homo sapiens
uaucagaucaugcugga

SEQ ID NO: 590 - RNA, 17 nt, Homo sapiens
gccaagauuugcagaac

SEQ ID NO: 591 - RNA, 17 nt, Homo sapiens
ccaagauuugcagaacu

SEQ ID NO: 592 - RNA, 17 nt, Homo sapiens
gcagaacuuguggaaaa

SEQ ID NO: 593 - RNA, 17 nt, Homo sapiens
gaaaaacuaggugauuu

SEQ ID NO: 594 - RNA, 17 nt, Homo sapiens
uaggugauuugcuucaa

SEQ ID NO: 595 - RNA, 17 nt, Homo sapiens
aggugauuugcuucaag

SEQ ID NO: 596 - RNA, 17 nt, Homo sapiens
gauuugcuucaagcaaa

SEQ ID NO: 597 - RNA, 17 nt, Homo sapiens
auuugcuucaagcaaau

SEQ ID NO: 598 - RNA, 17 nt, Homo sapiens
gcaaauguacaacagga

SEQ ID NO: 599 - RNA, 17 nt, Homo sapiens
aggaugguaaagacuac

SEQ ID NO: 600 - RNA, 17 nt, Homo sapiens
uaaagacuacaucccaa

SEQ ID NO: 601 - RNA, 17 nt, Homo sapiens
gacuacaucccaaucaa

SEQ ID NO: 602 - RNA, 17 nt, Homo sapiens
aucccaaucaaugccau

SEQ ID NO: 603 - RNA, 17 nt, Homo sapiens
aaugccauacugacagg

SEQ ID NO: 604 - RNA, 17 nt, Homo sapiens
caggaaauaguggguuu

SEQ ID NO: 605 - RNA, 17 nt, Homo sapiens
uaguggguuuacauacu

SEQ ID NO: 606 - RNA, 17 nt, Homo sapiens
aguggguuuacauacuc

SEQ ID NO: 607 - RNA, 17 nt, Homo sapiens
guggguuuacauacuca

SEQ ID NO: 608 - RNA, 17 nt, Homo sapiens
guuuacauacucaacuc

SEQ ID NO: 609 - RNA, 17 nt, Homo sapiens
uacauacucaacuccug

SEQ ID NO: 610 - RNA, 17 nt, Homo sapiens
acucaacuccugccuuc

SEQ ID NO: 611 - RNA, 17 nt, Homo sapiens
uccugccuucucugagg

SEQ ID NO: 612 - RNA, 17 nt, Homo sapiens
ccugccuucucugagga

SEQ ID NO: 613 - RNA, 17 nt, Homo sapiens
ugccuucucugaggacu

SEQ ID NO: 614 - RNA, 17 nt, Homo sapiens
ugaggacuucuucaagg

SEQ ID NO: 615 - RNA, 17 nt, Homo sapiens
gaggacuucuucaagga

SEQ ID NO: 616 - RNA, 17 nt, Homo sapiens
ggacuucuucaaggaaa

SEQ ID NO: 617 - RNA, 17 nt, Homo sapiens
gacuucuucaaggaaag

SEQ ID NO: 618 - RNA, 17 nt, Homo sapiens
aggaaaguauuucagcu

SEQ ID NO: 619 - RNA, 17 nt, Homo sapiens
gaaaguauuucagcucc

SEQ ID NO: 620 - RNA, 17 nt, Homo sapiens
aaaguauuucagcuccg

SEQ ID NO: 621 - RNA, 17 nt, Homo sapiens
aaguauuucagcuccga

SEQ ID NO: 622 - RNA, 17 nt, Homo sapiens
uuucagcuccgaaguuu

SEQ ID NO: 623 - RNA, 17 nt, Homo sapiens
uccgaaguuuaauucag

SEQ ID NO: 624 - RNA, 17 nt, Homo sapiens
ccgaaguuuaauucagg

SEQ ID NO: 625 - RNA, 17 nt, Homo sapiens
cgaaguuuaauucagga

SEQ ID NO: 626 - RNA, 17 nt, Homo sapiens
aguuuaauucaggaagc

SEQ ID NO: 627 - RNA, 17 nt, Homo sapiens
guuuaauucaggaagcu

SEQ ID NO: 628 - RNA, 17 nt, Homo sapiens
aggaagcucugaugaug

SEQ ID NO: 629 - RNA, 17 nt, Homo sapiens
gaugaugucagauaugu

SEQ ID NO: 630 - RNA, 17 nt, Homo sapiens
ugucagauauguaaaug

SEQ ID NO: 631 - RNA, 17 nt, Homo sapiens
agauauguaaaugcuuu

SEQ ID NO: 632 - RNA, 17 nt, Homo sapiens
uaaaugcuuucaaguuc

SEQ ID NO: 633 - RNA, 17 nt, Homo sapiens
aaaugcuuucaaguuca

SEQ ID NO: 634 - RNA, 17 nt, Homo sapiens
aaugcuuucaaguucau

SEQ ID NO: 635 - RNA, 17 nt, Homo sapiens
uuucaaguucaugagcc

SEQ ID NO: 636 - RNA, 17 nt, Homo sapiens
uucaaguucaugagccu

SEQ ID NO: 637 - RNA, 17 nt, Homo sapiens
gaaagaaucaaaaccuu

SEQ ID NO: 638 - RNA, 17 nt, Homo sapiens
caaaaccuuugaagaac

SEQ ID NO: 639 - RNA, 17 nt, Homo sapiens
aaaaccuuugaagaacu

SEQ ID NO: 640 - RNA, 17 nt, Homo sapiens
gaagaacuuuuaccgaa

SEQ ID NO: 641 - RNA, 17 nt, Homo sapiens
aagaacuuuuaccgaau

SEQ ID NO: 642 - RNA, 17 nt, Homo sapiens
agaacuuuuaccgaaug

SEQ ID NO: 643 - RNA, 17 nt, Homo sapiens
gaacuuuuaccgaaugc

SEQ ID NO: 644 - RNA, 17 nt, Homo sapiens
ugccaccuccauguuug

SEQ ID NO: 645 - RNA, 17 nt, Homo sapiens
cuccauguuugaugacu

SEQ ID NO: 646 - RNA, 17 nt, Homo sapiens
uccauguuugaugacua

SEQ ID NO: 647 - RNA, 17 nt, Homo sapiens
ugaugacuaccagggcg

SEQ ID NO: 648 - RNA, 17 nt, Homo sapiens
gcagcacucuguuggcc

SEQ ID NO: 649 - RNA, 17 nt, Homo sapiens
cacucuguuggccucuc

SEQ ID NO: 650 - RNA, 17 nt, Homo sapiens
guuggccucucccaugc

SEQ ID NO: 651 - RNA, 17 nt, Homo sapiens
uggccucucccaugcug

SEQ ID NO: 652 - RNA, 17 nt, Homo sapiens
gaagcgcuucaccugga

SEQ ID NO: 653 - RNA, 17 nt, Homo sapiens
aagcgcuucaccuggac

SEQ ID NO: 654 - RNA, 17 nt, Homo sapiens
caaggccucgcucaaga

SEQ ID NO: 655 - RNA, 17 nt, Homo sapiens
gccucgcucaagauuga

SEQ ID NO: 656 - RNA, 17 nt, Homo sapiens
cucaagauugacuugag

SEQ ID NO: 657 - RNA, 17 nt, Homo sapiens
gauugacuugagaguaa

SEQ ID NO: 658 - RNA, 17 nt, Homo sapiens
uugagaguaaccaguaa

SEQ ID NO: 659 - RNA, 17 nt, Homo sapiens
uaaccaguaaaaguaag

SEQ ID NO: 660 - RNA, 17 nt, Homo sapiens
guaaaaguaaggagucg

SEQ ID NO: 661 - RNA, 17 nt, Homo sapiens
uaaggagucggggcugu

SEQ ID NO: 662 - RNA, 17 nt, Homo sapiens
ggggcugucugauguca

SEQ ID NO: 663 - RNA, 17 nt, Homo sapiens
ucugaugucagcaggcc

SEQ ID NO: 664 - RNA, 17 nt, Homo sapiens
ggcccaguuucugccau

SEQ ID NO: 665 - RNA, 17 nt, Homo sapiens
gcccaguuucugccauu

SEQ ID NO: 666 - RNA, 17 nt, Homo sapiens
cccaguuucugccauuc

SEQ ID NO: 667 - RNA, 17 nt, Homo sapiens
ucugccauuccagcugu

SEQ ID NO: 668 - RNA, 17 nt, Homo sapiens
cugccauuccagcugug

SEQ ID NO: 669 - RNA, 17 nt, Homo sapiens
gggcacgucagcgaagg

SEQ ID NO: 670 - RNA, 17 nt, Homo sapiens
gcgcagguucaccuacg

SEQ ID NO: 671 - RNA, 17 nt, Homo sapiens
cgcagguucaccuacga

SEQ ID NO: 672 - RNA, 17 nt, Homo sapiens
guucaccuacgaccacg

SEQ ID NO: 673 - RNA, 17 nt, Homo sapiens
aggaaaaucgcgugcug

SEQ ID NO: 674 - RNA, 17 nt, Homo sapiens
gugcugcuccccgcccc

SEQ ID NO: 675 - RNA, 17 nt, Homo sapiens
cccagacuacaacucgg

SEQ ID NO: 676 - RNA, 17 nt, Homo sapiens
cuacaacucgguggucc

SEQ ID NO: 677 - RNA, 17 nt, Homo sapiens
ucggugguccuguacuc

SEQ ID NO: 678 - RNA, 17 nt, Homo sapiens
gguccuguacuccaccc

SEQ ID NO: 679 - RNA, 17 nt, Homo sapiens
ccuguacuccaccccac

SEQ ID NO: 680 - RNA, 17 nt, Homo sapiens
ccacccaucuagaguuu

SEQ ID NO: 681 - RNA, 17 nt, Homo sapiens
acccaucuagaguuuga

SEQ ID NO: 682 - RNA, 17 nt, Homo sapiens
ucuagaguuugacacga

SEQ ID NO: 683 - RNA, 17 nt, Homo sapiens
cuagaguuugacacgaa

SEQ ID NO: 684 - RNA, 17 nt, Homo sapiens
cgaagccuuauuucuag

SEQ ID NO: 685 - RNA, 17 nt, Homo sapiens
gaagccuuauuucuaga

SEQ ID NO: 686 - RNA, 17 nt, Homo sapiens
agccuuauuucuagaag

SEQ ID NO: 687 - RNA, 17 nt, Homo sapiens
gccuuauuucuagaagc

SEQ ID NO: 688 - RNA, 17 nt, Homo sapiens
ccuuauuucuagaagca

SEQ ID NO: 689 - RNA, 17 nt, Homo sapiens
uuauuucuagaagcaca

SEQ ID NO: 690 - RNA, 17 nt, Homo sapiens
acauguguauuuauacc

SEQ ID NO: 691 - RNA, 17 nt, Homo sapiens
auguguauuuauacccc

SEQ ID NO: 692 - RNA, 17 nt, Homo sapiens
uguguauuuauaccccc

SEQ ID NO: 693 - RNA, 17 nt, Homo sapiens
guguauuuauaccccca

SEQ ID NO: 694 - RNA, 17 nt, Homo sapiens
guauuuauacccccagg

SEQ ID NO: 695 - RNA, 17 nt, Homo sapiens
aggaaacuagcuuuugc

SEQ ID NO: 696 - RNA, 17 nt, Homo sapiens
aacuagcuuuugccagu

SEQ ID NO: 697 - RNA, 17 nt, Homo sapiens
acuagcuuuugccagua

SEQ ID NO: 698 - RNA, 17 nt, Homo sapiens
cuagcuuuugccaguau

SEQ ID NO: 699 - RNA, 17 nt, Homo sapiens
uugccaguauuaugcau

SEQ ID NO: 700 - RNA, 17 nt, Homo sapiens
gccaguauuaugcauau

SEQ ID NO: 701 - RNA, 17 nt, Homo sapiens
ccaguauuaugcauaua

SEQ ID NO: 702 - RNA, 17 nt, Homo sapiens
uuaugcauauauaaguu

SEQ ID NO: 703 - RNA, 17 nt, Homo sapiens
augcauauauaaguuua

SEQ ID NO: 704 - RNA, 17 nt, Homo sapiens
gcauauauaaguuuaca

SEQ ID NO: 705 - RNA, 17 nt, Homo sapiens
auauaaguuuacaccuu

SEQ ID NO: 706 - RNA, 17 nt, Homo sapiens
uauaaguuuacaccuuu

SEQ ID NO: 707 - RNA, 17 nt, Homo sapiens
auaaguuuacaccuuua

SEQ ID NO: 708 - RNA, 17 nt, Homo sapiens
uuacaccuuuaucuuuc

SEQ ID NO: 709 - RNA, 17 nt, Homo sapiens
uacaccuuuaucuuucc

SEQ ID NO: 710 - RNA, 17 nt, Homo sapiens
acaccuuuaucuuucca

SEQ ID NO: 711 - RNA, 17 nt, Homo sapiens
accuuuaucuuuccaug

SEQ ID NO: 712 - RNA, 17 nt, Homo sapiens
cuuuaucuuuccauggg

SEQ ID NO: 713 - RNA, 17 nt, Homo sapiens
uuuaucuuuccauggga

SEQ ID NO: 714 - RNA, 17 nt, Homo sapiens
uuaucuuuccaugggag

SEQ ID NO: 715 - RNA, 17 nt, Homo sapiens
cagcugcuuuuugugau

SEQ ID NO: 716 - RNA, 17 nt, Homo sapiens
agcugcuuuuugugauu

SEQ ID NO: 717 - RNA, 17 nt, Homo sapiens
gcugcuuuuugugauuu

SEQ ID NO: 718 - RNA, 17 nt, Homo sapiens
cugcuuuuugugauuuu

SEQ ID NO: 719 - RNA, 17 nt, Homo sapiens
uuugugauuuuuuuaau

SEQ ID NO: 720 - RNA, 17 nt, Homo sapiens
uugugauuuuuuuaaua

SEQ ID NO: 721 - RNA, 17 nt, Homo sapiens
ugugauuuuuuuaauag

SEQ ID NO: 722 - RNA, 17 nt, Homo sapiens
gugauuuuuuuaauagu

SEQ ID NO: 723 - RNA, 17 nt, Homo sapiens
ugauuuuuuuaauagug

SEQ ID NO: 724 - RNA, 17 nt, Homo sapiens
gauuuuuuuaauagugc

SEQ ID NO: 725 - RNA, 17 nt, Homo sapiens
auuuuuuuaauagugcu

SEQ ID NO: 726 - RNA, 17 nt, Homo sapiens
uuuuuaauagugcuuuu

SEQ ID NO: 727 - RNA, 17 nt, Homo sapiens
auagugcuuuuuuuuuu

SEQ ID NO: 728 - RNA, 17 nt, Homo sapiens
uagugcuuuuuuuuuuu

SEQ ID NO: 729 - RNA, 17 nt, Homo sapiens
agugcuuuuuuuuuuug

SEQ ID NO: 730 - RNA, 17 nt, Homo sapiens
gugcuuuuuuuuuuuga

SEQ ID NO: 731 - RNA, 17 nt, Homo sapiens
ugcuuuuuuuuuuugac

SEQ ID NO: 732 - RNA, 17 nt, Homo sapiens
gcuuuuuuuuuuugacu

SEQ ID NO: 733 - RNA, 17 nt, Homo sapiens
cuuuuuuuuuuugacua

SEQ ID NO: 734 - RNA, 17 nt, Homo sapiens
uuuuuuuuuuugacuaa

SEQ ID NO: 735 - RNA, 17 nt, Homo sapiens
uuuuuuuuuugacuaac

SEQ ID NO: 736 - RNA, 17 nt, Homo sapiens
uuuuuuuuugacuaaca

SEQ ID NO: 737 - RNA, 17 nt, Homo sapiens
uuuugacuaacaagaau

SEQ ID NO: 738 - RNA, 17 nt, Homo sapiens
aagaauguaacuccaga

SEQ ID NO: 739 - RNA, 17 nt, Homo sapiens
auguaacuccagauaga

SEQ ID NO: 740 - RNA, 17 nt, Homo sapiens
cuccagauagagaaaua

SEQ ID NO: 741 - RNA, 17 nt, Homo sapiens
agagaaauagugacaag

SEQ ID NO: 742 - RNA, 17 nt, Homo sapiens
agaacacuacugcuaaa

SEQ ID NO: 743 - RNA, 17 nt, Homo sapiens
cuacugcuaaauccuca

SEQ ID NO: 744 - RNA, 17 nt, Homo sapiens
ugcuaaauccucauguu

SEQ ID NO: 745 - RNA, 17 nt, Homo sapiens
uaaauccucauguuacu

SEQ ID NO: 746 - RNA, 17 nt, Homo sapiens
ccucauguuacucagug

SEQ ID NO: 747 - RNA, 17 nt, Homo sapiens
cucauguuacucagugu

SEQ ID NO: 748 - RNA, 17 nt, Homo sapiens
auguuacucaguguuag

SEQ ID NO: 749 - RNA, 17 nt, Homo sapiens
cucaguguuagagaaau

SEQ ID NO: 750 - RNA, 17 nt, Homo sapiens
ucaguguuagagaaauc

SEQ ID NO: 751 - RNA, 17 nt, Homo sapiens
agagaaauccuuccuaa

SEQ ID NO: 752 - RNA, 17 nt, Homo sapiens
gaaauccuuccuaaacc

SEQ ID NO: 753 - RNA, 17 nt, Homo sapiens
aaauccuuccuaaaccc

SEQ ID NO: 754 - RNA, 17 nt, Homo sapiens
uccuuccuaaacccaau

SEQ ID NO: 755 - RNA, 17 nt, Homo sapiens
caaugacuucccugcuc

SEQ ID NO: 756 - RNA, 17 nt, Homo sapiens
aaugacuucccugcucc

SEQ ID NO: 757 - RNA, 17 nt, Homo sapiens
ucccugcuccaaccccc

SEQ ID NO: 758 - RNA, 17 nt, Homo sapiens
cgccaccucagggcacg

SEQ ID NO: 759 - RNA, 17 nt, Homo sapiens
ggaccaguuugauugag

SEQ ID NO: 760 - RNA, 17 nt, Homo sapiens
gaccaguuugauugagg

SEQ ID NO: 761 - RNA, 17 nt, Homo sapiens
aguuugauugaggagcu

SEQ ID NO: 762 - RNA, 17 nt, Homo sapiens
gcacugaucacccaaug

SEQ ID NO: 763 - RNA, 17 nt, Homo sapiens
caaugcaucacguaccc

SEQ ID NO: 764 - RNA, 17 nt, Homo sapiens
caucacguaccccacug

SEQ ID NO: 765 - RNA, 17 nt, Homo sapiens
aagcccguuagccccag

SEQ ID NO: 766 - RNA, 17 nt, Homo sapiens
agcccguuagccccagg

SEQ ID NO: 767 - RNA, 17 nt, Homo sapiens
caggggaucacuggcug

SEQ ID NO: 768 - RNA, 17 nt, Homo sapiens
agcaacaucucgggagu

SEQ ID NO: 769 - RNA, 17 nt, Homo sapiens
caacaucucgggagucc

SEQ ID NO: 770 - RNA, 17 nt, Homo sapiens
ucgggaguccucuagca

SEQ ID NO: 771 - RNA, 17 nt, Homo sapiens
ggaguccucuagcaggc

SEQ ID NO: 772 - RNA, 17 nt, Homo sapiens
aguccucuagcaggccu

SEQ ID NO: 773 - RNA, 17 nt, Homo sapiens
gcaggccuaagacaugu

SEQ ID NO: 774 - RNA, 17 nt, Homo sapiens
gaaagaauuugagacgc

SEQ ID NO: 775 - RNA, 17 nt, Homo sapiens
aaagaauuugagacgca

SEQ ID NO: 776 - RNA, 17 nt, Homo sapiens
acggggcucagcaaugc

SEQ ID NO: 777 - RNA, 17 nt, Homo sapiens
aaugccauuucaguggc

SEQ ID NO: 778 - RNA, 17 nt, Homo sapiens
augccauuucaguggcu

SEQ ID NO: 779 - RNA, 17 nt, Homo sapiens
ugccauuucaguggcuu

SEQ ID NO: 780 - RNA, 17 nt, Homo sapiens
caguggcuucccagcuc

SEQ ID NO: 781 - RNA, 17 nt, Homo sapiens
aguggcuucccagcucu

SEQ ID NO: 782 - RNA, 17 nt, Homo sapiens
ucccagcucugacccuu

SEQ ID NO: 783 - RNA, 17 nt, Homo sapiens
cugacccuucuacauuu

SEQ ID NO: 784 - RNA, 17 nt, Homo sapiens
ugacccuucuacauuug

SEQ ID NO: 785 - RNA, 17 nt, Homo sapiens
acccuucuacauuugag

SEQ ID NO: 786 - RNA, 17 nt, Homo sapiens
uucuacauuugagggcc

SEQ ID NO: 787 - RNA, 17 nt, Homo sapiens
ucuacauuugagggccc

SEQ ID NO: 788 - RNA, 17 nt, Homo sapiens
ggggacauuuucuggau

SEQ ID NO: 789 - RNA, 17 nt, Homo sapiens
gggacauuuucuggauu

SEQ ID NO: 790 - RNA, 17 nt, Homo sapiens
ggacauuuucuggauuc

SEQ ID NO: 791 - RNA, 17 nt, Homo sapiens
gacauuuucuggauucu

SEQ ID NO: 792 - RNA, 17 nt, Homo sapiens
uucuggauucugggagg

SEQ ID NO: 793 - RNA, 17 nt, Homo sapiens
ucuggauucugggaggc

SEQ ID NO: 794 - RNA, 17 nt, Homo sapiens
ggacaaauaucuuuuuu

SEQ ID NO: 795 - RNA, 17 nt, Homo sapiens
acaaauaucuuuuuugg

SEQ ID NO: 796 - RNA, 17 nt, Homo sapiens
aaauaucuuuuuuggaa

SEQ ID NO: 797 - RNA, 17 nt, Homo sapiens
aauaucuuuuuuggaac

SEQ ID NO: 798 - RNA, 17 nt, Homo sapiens
auaucuuuuuuggaacu

SEQ ID NO: 799 - RNA, 17 nt, Homo sapiens
uaucuuuuuuggaacua

SEQ ID NO: 800 - RNA, 17 nt, Homo sapiens
aucuuuuuuggaacuaa

SEQ ID NO: 801 - RNA, 17 nt, Homo sapiens
uuggaacuaaagcaaau

SEQ ID NO: 802 - RNA, 17 nt, Homo sapiens
aagcaaauuuuagaccu

SEQ ID NO: 803 - RNA, 17 nt, Homo sapiens
agcaaauuuuagaccuu

SEQ ID NO: 804 - RNA, 17 nt, Homo sapiens
gcaaauuuuagaccuuu

SEQ ID NO: 805 - RNA, 17 nt, Homo sapiens
caaauuuuagaccuuua

SEQ ID NO: 806 - RNA, 17 nt, Homo sapiens
uuagaccuuuaccuaug

SEQ ID NO: 807 - RNA, 17 nt, Homo sapiens
uagaccuuuaccuaugg

SEQ ID NO: 808 - RNA, 17 nt, Homo sapiens
agaccuuuaccuaugga

SEQ ID NO: 809 - RNA, 17 nt, Homo sapiens
cuuuaccuauggaagug

SEQ ID NO: 810 - RNA, 17 nt, Homo sapiens
gaagugguucuaugucc

SEQ ID NO: 811 - RNA, 17 nt, Homo sapiens
aagugguucuaugucca

SEQ ID NO: 812 - RNA, 17 nt, Homo sapiens
gugguucuauguccauu

SEQ ID NO: 813 - RNA, 17 nt, Homo sapiens
uucuauguccauucuca

SEQ ID NO: 814 - RNA, 17 nt, Homo sapiens
auguccauucucauucg

SEQ ID NO: 815 - RNA, 17 nt, Homo sapiens
uguccauucucauucgu

SEQ ID NO: 816 - RNA, 17 nt, Homo sapiens
uccauucucauucgugg

SEQ ID NO: 817 - RNA, 17 nt, Homo sapiens
auucucauucguggcau

SEQ ID NO: 818 - RNA, 17 nt, Homo sapiens
uucucauucguggcaug

SEQ ID NO: 819 - RNA, 17 nt, Homo sapiens
uggcauguuuugauuug

SEQ ID NO: 820 - RNA, 17 nt, Homo sapiens
ggcauguuuugauuugu

SEQ ID NO: 821 - RNA, 17 nt, Homo sapiens
gcauguuuugauuugua

SEQ ID NO: 822 - RNA, 17 nt, Homo sapiens
guuuugauuuguagcac

SEQ ID NO: 823 - RNA, 17 nt, Homo sapiens
uuuugauuuguagcacu

SEQ ID NO: 824 - RNA, 17 nt, Homo sapiens
ugauuuguagcacugag

SEQ ID NO: 825 - RNA, 17 nt, Homo sapiens
guggcacucaacucuga

SEQ ID NO: 826 - RNA, 17 nt, Homo sapiens
acucaacucugagccca

SEQ ID NO: 827 - RNA, 17 nt, Homo sapiens
gagcccauacuuuuggc

SEQ ID NO: 828 - RNA, 17 nt, Homo sapiens
cccauacuuuuggcucc

SEQ ID NO: 829 - RNA, 17 nt, Homo sapiens
ccauacuuuuggcuccu

SEQ ID NO: 830 - RNA, 17 nt, Homo sapiens
cauacuuuuggcuccuc

SEQ ID NO: 831 - RNA, 17 nt, Homo sapiens
uuuuggcuccucuagua

SEQ ID NO: 832 - RNA, 17 nt, Homo sapiens
uggcuccucuaguaaga

SEQ ID NO: 833 - RNA, 17 nt, Homo sapiens
gcuccucuaguaagaug

SEQ ID NO: 834 - RNA, 17 nt, Homo sapiens
ccucuaguaagaugcac

SEQ ID NO: 835 - RNA, 17 nt, Homo sapiens
ugaaaacuuagccagag

SEQ ID NO: 836 - RNA, 17 nt, Homo sapiens
gaaaacuuagccagagu

SEQ ID NO: 837 - RNA, 17 nt, Homo sapiens
gccagaguuagguuguc

SEQ ID NO: 838 - RNA, 17 nt, Homo sapiens
ccagaguuagguugucu

SEQ ID NO: 839 - RNA, 17 nt, Homo sapiens
aguuagguugucuccag

SEQ ID NO: 840 - RNA, 17 nt, Homo sapiens
uagguugucuccaggcc

SEQ ID NO: 841 - RNA, 17 nt, Homo sapiens
gguugucuccaggccau

SEQ ID NO: 842 - RNA, 17 nt, Homo sapiens
gauggccuuacacugaa

SEQ ID NO: 843 - RNA, 17 nt, Homo sapiens
auggccuuacacugaaa

SEQ ID NO: 844 - RNA, 17 nt, Homo sapiens
gaaaaugucacauucua

SEQ ID NO: 845 - RNA, 17 nt, Homo sapiens
ugucacauucuauuuug

SEQ ID NO: 846 - RNA, 17 nt, Homo sapiens
gucacauucuauuuugg

SEQ ID NO: 847 - RNA, 17 nt, Homo sapiens
cacauucuauuuugggu

SEQ ID NO: 848 - RNA, 17 nt, Homo sapiens
cauucuauuuuggguau

SEQ ID NO: 849 - RNA, 17 nt, Homo sapiens
auucuauuuuggguauu

SEQ ID NO: 850 - RNA, 17 nt, Homo sapiens
uucuauuuuggguauua

SEQ ID NO: 851 - RNA, 17 nt, Homo sapiens
uuuuggguauuaauaua

SEQ ID NO: 852 - RNA, 17 nt, Homo sapiens
uuggguauuaauauaua

SEQ ID NO: 853 - RNA, 17 nt, Homo sapiens
uggguauuaauauauag

SEQ ID NO: 854 - RNA, 17 nt, Homo sapiens
guauuaauauauagucc

SEQ ID NO: 855 - RNA, 17 nt, Homo sapiens
auuaauauauaguccag

SEQ ID NO: 856 - RNA, 17 nt, Homo sapiens
uaauauauaguccagac

SEQ ID NO: 857 - RNA, 17 nt, Homo sapiens
uauauaguccagacacu

SEQ ID NO: 858 - RNA, 17 nt, Homo sapiens
cagacacuuaacucaau

SEQ ID NO: 859 - RNA, 17 nt, Homo sapiens
agacacuuaacucaauu

SEQ ID NO: 860 - RNA, 17 nt, Homo sapiens
acuuaacucaauuucuu

SEQ ID NO: 861 - RNA, 17 nt, Homo sapiens
aacucaauuucuuggua

SEQ ID NO: 862 - RNA, 17 nt, Homo sapiens
acucaauuucuugguau

SEQ ID NO: 863 - RNA, 17 nt, Homo sapiens
cucaauuucuugguauu

SEQ ID NO: 864 - RNA, 17 nt, Homo sapiens
caauuucuugguauuau

SEQ ID NO: 865 - RNA, 17 nt, Homo sapiens
uucuugguauuauucug

SEQ ID NO: 866 - RNA, 17 nt, Homo sapiens
cuugguauuauucuguu

SEQ ID NO: 867 - RNA, 17 nt, Homo sapiens
uugguauuauucuguuu

SEQ ID NO: 868 - RNA, 17 nt, Homo sapiens
gguauuauucuguuuug

SEQ ID NO: 869 - RNA, 17 nt, Homo sapiens
guauuauucuguuuugc

SEQ ID NO: 870 - RNA, 17 nt, Homo sapiens
uauucuguuuugcacag

SEQ ID NO: 871 - RNA, 17 nt, Homo sapiens
auucuguuuugcacagu

SEQ ID NO: 872 - RNA, 17 nt, Homo sapiens
uucuguuuugcacaguu

SEQ ID NO: 873 - RNA, 17 nt, Homo sapiens
ugcacaguuaguuguga

SEQ ID NO: 874 - RNA, 17 nt, Homo sapiens
gcacaguuaguugugaa

SEQ ID NO: 875 - RNA, 17 nt, Homo sapiens
caguuaguugugaaaga

SEQ ID NO: 876 - RNA, 17 nt, Homo sapiens
aaugcaguccugaggag

SEQ ID NO: 877 - RNA, 17 nt, Homo sapiens
aggagaguuuucuccau

SEQ ID NO: 878 - RNA, 17 nt, Homo sapiens
ggagaguuuucuccaua

SEQ ID NO: 879 - RNA, 17 nt, Homo sapiens
gagaguuuucuccauau

SEQ ID NO: 880 - RNA, 17 nt, Homo sapiens
agaguuuucuccauauc

SEQ ID NO: 881 - RNA, 17 nt, Homo sapiens
aguuuucuccauaucaa

SEQ ID NO: 882 - RNA, 17 nt, Homo sapiens
uucuccauaucaaaacg

SEQ ID NO: 883 - RNA, 17 nt, Homo sapiens
cuccauaucaaaacgag

SEQ ID NO: 884 - RNA, 17 nt, Homo sapiens
aaaaaggucaauaaggu

SEQ ID NO: 885 - RNA, 17 nt, Homo sapiens
aggucaauaaggucaag

SEQ ID NO: 886 - RNA, 17 nt, Homo sapiens
aauaaggucaagggaag

SEQ ID NO: 887 - RNA, 17 nt, Homo sapiens
gaccccgucucuauacc

SEQ ID NO: 888 - RNA, 17 nt, Homo sapiens
ccccgucucuauaccaa

SEQ ID NO: 889 - RNA, 17 nt, Homo sapiens
ccgucucuauaccaacc

SEQ ID NO: 890 - RNA, 17 nt, Homo sapiens
gucucuauaccaaccaa

SEQ ID NO: 891 - RNA, 17 nt, Homo sapiens
aaaccaauucaccaaca

SEQ ID NO: 892 - RNA, 17 nt, Homo sapiens
aaccaauucaccaacac

SEQ ID NO: 893 - RNA, 17 nt, Homo sapiens
aacacaguugggaccca

SEQ ID NO: 894 - RNA, 17 nt, Homo sapiens
caggaagucagucacgu

SEQ ID NO: 895 - RNA, 17 nt, Homo sapiens
aagucagucacguuucc

SEQ ID NO: 896 - RNA, 17 nt, Homo sapiens
agucacguuuccuuuuc

SEQ ID NO: 897 - RNA, 17 nt, Homo sapiens
gucacguuuccuuuuca

SEQ ID NO: 898 - RNA, 17 nt, Homo sapiens
ucacguuuccuuuucau

SEQ ID NO: 899 - RNA, 17 nt, Homo sapiens
cguuuccuuuucauuua

SEQ ID NO: 900 - RNA, 17 nt, Homo sapiens
guuuccuuuucauuuaa

SEQ ID NO: 901 - RNA, 17 nt, Homo sapiens
uuuccuuuucauuuaau

SEQ ID NO: 902 - RNA, 17 nt, Homo sapiens
uuccuuuucauuuaaug

SEQ ID NO: 903 - RNA, 17 nt, Homo sapiens
cuuuucauuuaaugggg

SEQ ID NO: 904 - RNA, 17 nt, Homo sapiens
uuuucauuuaaugggga

SEQ ID NO: 905 - RNA, 17 nt, Homo sapiens
uuucauuuaauggggau

SEQ ID NO: 906 - RNA, 17 nt, Homo sapiens
auggggauuccacuauc

SEQ ID NO: 907 - RNA, 17 nt, Homo sapiens
uggggauuccacuaucu

SEQ ID NO: 908 - RNA, 17 nt, Homo sapiens
auuccacuaucucacac

SEQ ID NO: 909 - RNA, 17 nt, Homo sapiens
uccacuaucucacacua

SEQ ID NO: 910 - RNA, 17 nt, Homo sapiens
cacuaucucacacuaau

SEQ ID NO: 911 - RNA, 17 nt, Homo sapiens
cucacacuaaucugaaa

SEQ ID NO: 912 - RNA, 17 nt, Homo sapiens
acacuaaucugaaagga

SEQ ID NO: 913 - RNA, 17 nt, Homo sapiens
aagagcauuagcuggcg

SEQ ID NO: 914 - RNA, 17 nt, Homo sapiens
agagcauuagcuggcgc

SEQ ID NO: 915 - RNA, 17 nt, Homo sapiens
uggcgcauauuaagcac

SEQ ID NO: 916 - RNA, 17 nt, Homo sapiens
gcgcauauuaagcacuu

SEQ ID NO: 917 - RNA, 17 nt, Homo sapiens
cgcauauuaagcacuuu

SEQ ID NO: 918 - RNA, 17 nt, Homo sapiens
uaagcacuuuaagcucc

SEQ ID NO: 919 - RNA, 17 nt, Homo sapiens
aagcacuuuaagcuccu

SEQ ID NO: 920 - RNA, 17 nt, Homo sapiens
agcacuuuaagcuccuu

SEQ ID NO: 921 - RNA, 17 nt, Homo sapiens
uuuaagcuccuugagua

SEQ ID NO: 922 - RNA, 17 nt, Homo sapiens
aagcuccuugaguaaaa

SEQ ID NO: 923 - RNA, 17 nt, Homo sapiens
ccuugaguaaaaaggug

SEQ ID NO: 924 - RNA, 17 nt, Homo sapiens
aaggugguauguaauuu

SEQ ID NO: 925 - RNA, 17 nt, Homo sapiens
ugguauguaauuuaugc

SEQ ID NO: 926 - RNA, 17 nt, Homo sapiens
uauguaauuuaugcaag

SEQ ID NO: 927 - RNA, 17 nt, Homo sapiens
auguaauuuaugcaagg

SEQ ID NO: 928 - RNA, 17 nt, Homo sapiens
uguaauuuaugcaaggu

SEQ ID NO: 929 - RNA, 17 nt, Homo sapiens
ugcaagguauuucucca

SEQ ID NO: 930 - RNA, 17 nt, Homo sapiens
caagguauuucuccagu

SEQ ID NO: 931 - RNA, 17 nt, Homo sapiens
aagguauuucuccaguu

SEQ ID NO: 932 - RNA, 17 nt, Homo sapiens
agguauuucuccaguug

SEQ ID NO: 933 - RNA, 17 nt, Homo sapiens
guauuucuccaguuggg

SEQ ID NO: 934 - RNA, 17 nt, Homo sapiens
ucuccaguugggacuca

SEQ ID NO: 935 - RNA, 17 nt, Homo sapiens
uugggacucaggauauu

SEQ ID NO: 936 - RNA, 17 nt, Homo sapiens
cucaggauauuaguuaa

SEQ ID NO: 937 - RNA, 17 nt, Homo sapiens
caggauauuaguuaaug

SEQ ID NO: 938 - RNA, 17 nt, Homo sapiens
aggauauuaguuaauga

SEQ ID NO: 939 - RNA, 17 nt, Homo sapiens
auauuaguuaaugagcc

SEQ ID NO: 940 - RNA, 17 nt, Homo sapiens
uauuaguuaaugagcca

SEQ ID NO: 941 - RNA, 17 nt, Homo sapiens
ugagccaucacuagaag

SEQ ID NO: 942 - RNA, 17 nt, Homo sapiens
ccaucacuagaagaaaa

SEQ ID NO: 943 - RNA, 17 nt, Homo sapiens
aagcccauuuucaacug

SEQ ID NO: 944 - RNA, 17 nt, Homo sapiens
agcccauuuucaacugc

SEQ ID NO: 945 - RNA, 17 nt, Homo sapiens
gcccauuuucaacugcu

SEQ ID NO: 946 - RNA, 17 nt, Homo sapiens
cccauuuucaacugcuu

SEQ ID NO: 947 - RNA, 17 nt, Homo sapiens
caacugcuuugaaacuu

SEQ ID NO: 948 - RNA, 17 nt, Homo sapiens
aacugcuuugaaacuug

SEQ ID NO: 949 - RNA, 17 nt, Homo sapiens
uugaaacuugccugggg

SEQ ID NO: 950 - RNA, 17 nt, Homo sapiens
ccuggggucugagcaug

SEQ ID NO: 951 - RNA, 17 nt, Homo sapiens
augggaauagggagaca

SEQ ID NO: 952 - RNA, 17 nt, Homo sapiens
gacaggguaggaaaggg

SEQ ID NO: 953 - RNA, 17 nt, Homo sapiens
gggcgccuacucuucag

SEQ ID NO: 954 - RNA, 17 nt, Homo sapiens
cgccuacucuucagggu

SEQ ID NO: 955 - RNA, 17 nt, Homo sapiens
ccuacucuucagggucu

SEQ ID NO: 956 - RNA, 17 nt, Homo sapiens
cuacucuucagggucua

SEQ ID NO: 957 - RNA, 17 nt, Homo sapiens
uucagggucuaaagauc

SEQ ID NO: 958 - RNA, 17 nt, Homo sapiens
cagggucuaaagaucaa

SEQ ID NO: 959 - RNA, 17 nt, Homo sapiens
cuaaagaucaagugggc

SEQ ID NO: 960 - RNA, 17 nt, Homo sapiens
gugggccuuggaucgcu

SEQ ID NO: 961 - RNA, 17 nt, Homo sapiens
ccuuggaucgcuaagcu

SEQ ID NO: 962 - RNA, 17 nt, Homo sapiens
ggaucgcuaagcuggcu

SEQ ID NO: 963 - RNA, 17 nt, Homo sapiens
agcuggcucuguuugau

SEQ ID NO: 964 - RNA, 17 nt, Homo sapiens
ggcucuguuugaugcua

SEQ ID NO: 965 - RNA, 17 nt, Homo sapiens
gcucuguuugaugcuau

SEQ ID NO: 966 - RNA, 17 nt, Homo sapiens
uugaugcuauuuaugca

SEQ ID NO: 967 - RNA, 17 nt, Homo sapiens
gaugcuauuuaugcaag

SEQ ID NO: 968 - RNA, 17 nt, Homo sapiens
augcuauuuaugcaagu

SEQ ID NO: 969 - RNA, 17 nt, Homo sapiens
ugcuauuuaugcaaguu

SEQ ID NO: 970 - RNA, 17 nt, Homo sapiens
augcaaguuagggucua

SEQ ID NO: 971 - RNA, 17 nt, Homo sapiens
ugcaaguuagggucuau

SEQ ID NO: 972 - RNA, 17 nt, Homo sapiens
guuagggucuauguauu

SEQ ID NO: 973 - RNA, 17 nt, Homo sapiens
uagggucuauguauuua

SEQ ID NO: 974 - RNA, 17 nt, Homo sapiens
gucuauguauuuaggau

SEQ ID NO: 975 - RNA, 17 nt, Homo sapiens
cuauguauuuaggaugc

SEQ ID NO: 976 - RNA, 17 nt, Homo sapiens
uauguauuuaggaugcg

SEQ ID NO: 977 - RNA, 17 nt, Homo sapiens
auguauuuaggaugcgc

SEQ ID NO: 978 - RNA, 17 nt, Homo sapiens
augcgccuacucuucag

SEQ ID NO: 979 - RNA, 17 nt, Homo sapiens
cuauguauuuaggaugu

SEQ ID NO: 980 - RNA, 17 nt, Homo sapiens
uauguauuuaggauguc

SEQ ID NO: 981 - RNA, 17 nt, Homo sapiens
auguauuuaggaugucu

SEQ ID NO: 982 - RNA, 17 nt, Homo sapiens
uaggaugucugcaccuu

SEQ ID NO: 983 - RNA, 17 nt, Homo sapiens
cugcaccuucugcagcc

SEQ ID NO: 984 - RNA, 17 nt, Homo sapiens
ugcaccuucugcagcca

SEQ ID NO: 985 - RNA, 17 nt, Homo sapiens
cagccagucagaagcug

SEQ ID NO: 986 - RNA, 17 nt, Homo sapiens
caguggauugcugcuuc

SEQ ID NO: 987 - RNA, 17 nt, Homo sapiens
uugcugcuucuugggga

SEQ ID NO: 988 - RNA, 17 nt, Homo sapiens
ugcugcuucuuggggag

SEQ ID NO: 989 - RNA, 17 nt, Homo sapiens
cugcuucuuggggagaa

SEQ ID NO: 990 - RNA, 17 nt, Homo sapiens
agaagaguaugcuuccu

SEQ ID NO: 991 - RNA, 17 nt, Homo sapiens
aguaugcuuccuuuuau

SEQ ID NO: 992 - RNA, 17 nt, Homo sapiens
guaugcuuccuuuuauc

SEQ ID NO: 993 - RNA, 17 nt, Homo sapiens
ugcuuccuuuuauccau

SEQ ID NO: 994 - RNA, 17 nt, Homo sapiens
gcuuccuuuuauccaug

SEQ ID NO: 995 - RNA, 17 nt, Homo sapiens
cuuccuuuuauccaugu

SEQ ID NO: 996 - RNA, 17 nt, Homo sapiens
uuccuuuuauccaugua

SEQ ID NO: 997 - RNA, 17 nt, Homo sapiens
ccuuuuauccauguaau

SEQ ID NO: 998 - RNA, 17 nt, Homo sapiens
auccauguaauuuaacu

SEQ ID NO: 999 - RNA, 17 nt, Homo sapiens
cauguaauuuaacugua

SEQ ID NO: 1000 - RNA, 17 nt, Homo sapiens
auguaauuuaacuguag

SEQ ID NO: 1001 - RNA, 17 nt, Homo sapiens
uguaauuuaacuguaga

SEQ ID NO: 1002 - RNA, 17 nt, Homo sapiens
uuaacuguagaaccuga

SEQ ID NO: 1003 - RNA, 17 nt, Homo sapiens
ccugagcucuaaguaac

SEQ ID NO: 1004 - RNA, 17 nt, Homo sapiens
ugagcucuaaguaaccg

SEQ ID NO: 1005 - RNA, 17 nt, Homo sapiens
cucuaaguaaccgaaga

SEQ ID NO: 1006 - RNA, 17 nt, Homo sapiens
aagaauguaugccucug

SEQ ID NO: 1007 - RNA, 17 nt, Homo sapiens
guaugccucuguucuua

SEQ ID NO: 1008 - RNA, 17 nt, Homo sapiens
gccucuguucuuaugug

SEQ ID NO: 1009 - RNA, 17 nt, Homo sapiens
ccucuguucuuaugugc

SEQ ID NO: 1010 - RNA, 17 nt, Homo sapiens
ucuguucuuaugugcca

SEQ ID NO: 1011 - RNA, 17 nt, Homo sapiens
cuguucuuaugugccac

SEQ ID NO: 1012 - RNA, 17 nt, Homo sapiens
ugccacauccuuguuua

SEQ ID NO: 1013 - RNA, 17 nt, Homo sapiens
cacauccuuguuuaaag

SEQ ID NO: 1014 - RNA, 17 nt, Homo sapiens
auccuuguuuaaaggcu

SEQ ID NO: 1015 - RNA, 17 nt, Homo sapiens
uccuuguuuaaaggcuc

SEQ ID NO: 1016 - RNA, 17 nt, Homo sapiens
ccuuguuuaaaggcucu

SEQ ID NO: 1017 - RNA, 17 nt, Homo sapiens
uaaaggcucucuguaug

SEQ ID NO: 1018 - RNA, 17 nt, Homo sapiens
aaggcucucuguaugaa

SEQ ID NO: 1019 - RNA, 17 nt, Homo sapiens
cucucuguaugaagaga

SEQ ID NO: 1020 - RNA, 17 nt, Homo sapiens
gggaccgucaucagcac

SEQ ID NO: 1021 - RNA, 17 nt, Homo sapiens
accgucaucagcacauu

SEQ ID NO: 1022 - RNA, 17 nt, Homo sapiens
cagcacauucccuagug

SEQ ID NO: 1023 - RNA, 17 nt, Homo sapiens
agcacauucccuaguga

SEQ ID NO: 1024 - RNA, 17 nt, Homo sapiens
cauucccuagugagccu

SEQ ID NO: 1025 - RNA, 17 nt, Homo sapiens
gugagccuacuggcucc

SEQ ID NO: 1026 - RNA, 17 nt, Homo sapiens
uacuggcuccuggcagc

SEQ ID NO: 1027 - RNA, 17 nt, Homo sapiens
cagcggcuuuuguggaa

SEQ ID NO: 1028 - RNA, 17 nt, Homo sapiens
agcggcuuuuguggaag

SEQ ID NO: 1029 - RNA, 17 nt, Homo sapiens
gcggcuuuuguggaaga

SEQ ID NO: 1030 - RNA, 17 nt, Homo sapiens
ggaagacucacuagcca

SEQ ID NO: 1031 - RNA, 17 nt, Homo sapiens
gacucacuagccagaag

SEQ ID NO: 1032 - RNA, 17 nt, Homo sapiens
gggacaguccucuccac

SEQ ID NO: 1033 - RNA, 17 nt, Homo sapiens
acaguccucuccaccaa

SEQ ID NO: 1034 - RNA, 17 nt, Homo sapiens
aguccucuccaccaaga

SEQ ID NO: 1035 - RNA, 17 nt, Homo sapiens
accaagaucuaaaucca

SEQ ID NO: 1036 - RNA, 17 nt, Homo sapiens
caagaucuaaauccaaa

SEQ ID NO: 1037 - RNA, 17 nt, Homo sapiens
aucuaaauccaaacaaa

SEQ ID NO: 1038 - RNA, 17 nt, Homo sapiens
agcaggcuagagccaga

SEQ ID NO: 1039 - RNA, 17 nt, Homo sapiens
ggacaaaucuuuguugu

SEQ ID NO: 1040 - RNA, 17 nt, Homo sapiens
acaaaucuuuguuguuc

SEQ ID NO: 1041 - RNA, 17 nt, Homo sapiens
caaaucuuuguuguucc

SEQ ID NO: 1042 - RNA, 17 nt, Homo sapiens
aucuuuguuguuccucu

SEQ ID NO: 1043 - RNA, 17 nt, Homo sapiens
uuuguuguuccucuucu

SEQ ID NO: 1044 - RNA, 17 nt, Homo sapiens
uuguuguuccucuucuu

SEQ ID NO: 1045 - RNA, 17 nt, Homo sapiens
uuguuccucuucuuuac

SEQ ID NO: 1046 - RNA, 17 nt, Homo sapiens
guuccucuucuuuacac

SEQ ID NO: 1047 - RNA, 17 nt, Homo sapiens
uuccucuucuuuacaca

SEQ ID NO: 1048 - RNA, 17 nt, Homo sapiens
ccucuucuuuacacaua

SEQ ID NO: 1049 - RNA, 17 nt, Homo sapiens
cucuucuuuacacauac

SEQ ID NO: 1050 - RNA, 17 nt, Homo sapiens
ucuucuuuacacauacg

SEQ ID NO: 1051 - RNA, 17 nt, Homo sapiens
uuacacauacgcaaacc

SEQ ID NO: 1052 - RNA, 17 nt, Homo sapiens
cuggcaauuuuauaaau

SEQ ID NO: 1053 - RNA, 17 nt, Homo sapiens
uggcaauuuuauaaauc

SEQ ID NO: 1054 - RNA, 17 nt, Homo sapiens
ggcaauuuuauaaauca

SEQ ID NO: 1055 - RNA, 17 nt, Homo sapiens
gcaauuuuauaaaucag

SEQ ID NO: 1056 - RNA, 17 nt, Homo sapiens
aauuuuauaaaucaggu

SEQ ID NO: 1057 - RNA, 17 nt, Homo sapiens
uuauaaaucagguaacu

SEQ ID NO: 1058 - RNA, 17 nt, Homo sapiens
aaucagguaacuggaag

SEQ ID NO: 1059 - RNA, 17 nt, Homo sapiens
aaggagguuaaacucag

SEQ ID NO: 1060 - RNA, 17 nt, Homo sapiens
aggagguuaaacucaga

SEQ ID NO: 1061 - RNA, 17 nt, Homo sapiens
guuaaacucagaaaaaa

SEQ ID NO: 1062 - RNA, 17 nt, Homo sapiens
gaagaccucagucaauu

SEQ ID NO: 1063 - RNA, 17 nt, Homo sapiens
accucagucaauucucu

SEQ ID NO: 1064 - RNA, 17 nt, Homo sapiens
cagucaauucucuacuu

SEQ ID NO: 1065 - RNA, 17 nt, Homo sapiens
agucaauucucuacuuu

SEQ ID NO: 1066 - RNA, 17 nt, Homo sapiens
ucaauucucuacuuuuu

SEQ ID NO: 1067 - RNA, 17 nt, Homo sapiens
aauucucuacuuuuuuu

SEQ ID NO: 1068 - RNA, 17 nt, Homo sapiens
ucucuacuuuuuuuuuu

SEQ ID NO: 1069 - RNA, 17 nt, Homo sapiens
cucuacuuuuuuuuuuu

SEQ ID NO: 1070 - RNA, 17 nt, Homo sapiens
ucuacuuuuuuuuuuuu

SEQ ID NO: 1071 - RNA, 17 nt, Homo sapiens
cuacuuuuuuuuuuuuu

SEQ ID NO: 1072 - RNA, 17 nt, Homo sapiens
uacuuuuuuuuuuuuuu

SEQ ID NO: 1073 - RNA, 17 nt, Homo sapiens
acuuuuuuuuuuuuuuu

SEQ ID NO: 1074 - RNA, 17 nt, Homo sapiens
cuuuuuuuuuuuuuuuu

SEQ ID NO: 1075 - RNA, 17 nt, Homo sapiens
uuuuuuuuuuuuuuuuc

SEQ ID NO: 1076 - RNA, 17 nt, Homo sapiens
uuuuuuuuuuuuuuucc

SEQ ID NO: 1077 - RNA, 17 nt, Homo sapiens
uuuuuuuuuuuuuucca

SEQ ID NO: 1078 - RNA, 17 nt, Homo sapiens
uuuuuuuuuuuuuccaa

SEQ ID NO: 1079 - RNA, 17 nt, Homo sapiens
uuuuuuuuuuuuccaaa

SEQ ID NO: 1080 - RNA, 17 nt, Homo sapiens
uuuuuuuuuuuccaaau

SEQ ID NO: 1081 - RNA, 17 nt, Homo sapiens
uuuuuuuuuuccaaauc

SEQ ID NO: 1082 - RNA, 17 nt, Homo sapiens
uuuuuuuuuccaaauca

SEQ ID NO: 1083 - RNA, 17 nt, Homo sapiens
uuuuuuuuccaaaucag

SEQ ID NO: 1084 - RNA, 17 nt, Homo sapiens
uuccaaaucagauaaua

SEQ ID NO: 1085 - RNA, 17 nt, Homo sapiens
aaucagauaauagccca

SEQ ID NO: 1086 - RNA, 17 nt, Homo sapiens
cagauaauagcccagca

SEQ ID NO: 1087 - RNA, 17 nt, Homo sapiens
cagcaaauagugauaac

SEQ ID NO: 1088 - RNA, 17 nt, Homo sapiens
auagugauaacaaauaa

SEQ ID NO: 1089 - RNA, 17 nt, Homo sapiens
uaacaaauaaaaccuua

SEQ ID NO: 1090 - RNA, 17 nt, Homo sapiens
uaaaaccuuagcuguuc

SEQ ID NO: 1091 - RNA, 17 nt, Homo sapiens
aaaaccuuagcuguuca

SEQ ID NO: 1092 - RNA, 17 nt, Homo sapiens
uuagcuguucaugucuu

SEQ ID NO: 1093 - RNA, 17 nt, Homo sapiens
uagcuguucaugucuug

SEQ ID NO: 1094 - RNA, 17 nt, Homo sapiens
guucaugucuugauuuc

SEQ ID NO: 1095 - RNA, 17 nt, Homo sapiens
ucaugucuugauuucaa

SEQ ID NO: 1096 - RNA, 17 nt, Homo sapiens
gucuugauuucaauaau

SEQ ID NO: 1097 - RNA, 17 nt, Homo sapiens
ucuugauuucaauaauu

SEQ ID NO: 1098 - RNA, 17 nt, Homo sapiens
cuugauuucaauaauua

SEQ ID NO: 1099 - RNA, 17 nt, Homo sapiens
auuucaauaauuaauuc

SEQ ID NO: 1100 - RNA, 17 nt, Homo sapiens
ucaauaauuaauucuua

SEQ ID NO: 1101 - RNA, 17 nt, Homo sapiens
caauaauuaauucuuaa

SEQ ID NO: 1102 - RNA, 17 nt, Homo sapiens
uaauuaauucuuaauca

SEQ ID NO: 1103 - RNA, 17 nt, Homo sapiens
aauuaauucuuaaucau

SEQ ID NO: 1104 - RNA, 17 nt, Homo sapiens
uuaauucuuaaucauua

SEQ ID NO: 1105 - RNA, 17 nt, Homo sapiens
uaauucuuaaucauuaa

SEQ ID NO: 1106 - RNA, 17 nt, Homo sapiens
uucuuaaucauuaagag

SEQ ID NO: 1107 - RNA, 17 nt, Homo sapiens
uuaaucauuaagagacc

SEQ ID NO: 1108 - RNA, 17 nt, Homo sapiens
uaaucauuaagagacca

SEQ ID NO: 1109 - RNA, 17 nt, Homo sapiens
gagaccauaauaaauac

SEQ ID NO: 1110 - RNA, 17 nt, Homo sapiens
accauaauaaauacucc

SEQ ID NO: 1111 - RNA, 17 nt, Homo sapiens
uaauaaauacuccuuuu

SEQ ID NO: 1112 - RNA, 17 nt, Homo sapiens
uaaauacuccuuuucaa

SEQ ID NO: 1113 - RNA, 17 nt, Homo sapiens
auacuccuuuucaagag

SEQ ID NO: 1114 - RNA, 17 nt, Homo sapiens
uacuccuuuucaagaga

SEQ ID NO: 1115 - RNA, 17 nt, Homo sapiens
acuccuuuucaagagaa

SEQ ID NO: 1116 - RNA, 17 nt, Homo sapiens
cuccuuuucaagagaaa

SEQ ID NO: 1117 - RNA, 17 nt, Homo sapiens
aaaaccauuagaauugu

SEQ ID NO: 1118 - RNA, 17 nt, Homo sapiens
aaaccauuagaauuguu

SEQ ID NO: 1119 - RNA, 17 nt, Homo sapiens
auuagaauuguuacuca

SEQ ID NO: 1120 - RNA, 17 nt, Homo sapiens
agaauuguuacucagcu

SEQ ID NO: 1121 - RNA, 17 nt, Homo sapiens
gaauuguuacucagcuc

SEQ ID NO: 1122 - RNA, 17 nt, Homo sapiens
uuguuacucagcuccuu

SEQ ID NO: 1123 - RNA, 17 nt, Homo sapiens
acucagcuccuucaaac

SEQ ID NO: 1124 - RNA, 17 nt, Homo sapiens
cagcuccuucaaacuca

SEQ ID NO: 1125 - RNA, 17 nt, Homo sapiens
agcuccuucaaacucag

SEQ ID NO: 1126 - RNA, 17 nt, Homo sapiens
uucaaacucagguuugu

SEQ ID NO: 1127 - RNA, 17 nt, Homo sapiens
acucagguuuguagcau

SEQ ID NO: 1128 - RNA, 17 nt, Homo sapiens
cucagguuuguagcaua

SEQ ID NO: 1129 - RNA, 17 nt, Homo sapiens
agguuuguagcauacau

SEQ ID NO: 1130 - RNA, 17 nt, Homo sapiens
uguagcauacaugaguc

SEQ ID NO: 1131 - RNA, 17 nt, Homo sapiens
acaugaguccauccauc

SEQ ID NO: 1132 - RNA, 17 nt, Homo sapiens
gaguccauccaucaguc

SEQ ID NO: 1133 - RNA, 17 nt, Homo sapiens
ccauccaucagucaaag

SEQ ID NO: 1134 - RNA, 17 nt, Homo sapiens
ccaucagucaaagaaug

SEQ ID NO: 1135 - RNA, 17 nt, Homo sapiens
agaaugguuccaucugg

SEQ ID NO: 1136 - RNA, 17 nt, Homo sapiens
gaaugguuccaucugga

SEQ ID NO: 1137 - RNA, 17 nt, Homo sapiens
gguuccaucuggagucu

SEQ ID NO: 1138 - RNA, 17 nt, Homo sapiens
ucuggagucuuaaugua

SEQ ID NO: 1139 - RNA, 17 nt, Homo sapiens
uggagucuuaauguaga

SEQ ID NO: 1140 - RNA, 17 nt, Homo sapiens
ggagucuuaauguagaa

SEQ ID NO: 1141 - RNA, 17 nt, Homo sapiens
cuuaauguagaaagaaa

SEQ ID NO: 1142 - RNA, 17 nt, Homo sapiens
uggagacuuguaauaau

SEQ ID NO: 1143 - RNA, 17 nt, Homo sapiens
agacuuguaauaaugag

SEQ ID NO: 1144 - RNA, 17 nt, Homo sapiens
cuuguaauaaugagcua

SEQ ID NO: 1145 - RNA, 17 nt, Homo sapiens
aaugagcuaguuacaaa

SEQ ID NO: 1146 - RNA, 17 nt, Homo sapiens
gagcuaguuacaaagug

SEQ ID NO: 1147 - RNA, 17 nt, Homo sapiens
agcuaguuacaaagugc

SEQ ID NO: 1148 - RNA, 17 nt, Homo sapiens
aaagugcuuguucauua

SEQ ID NO: 1149 - RNA, 17 nt, Homo sapiens
gugcuuguucauuaaaa

SEQ ID NO: 1150 - RNA, 17 nt, Homo sapiens
ugcuuguucauuaaaau

SEQ ID NO: 1151 - RNA, 17 nt, Homo sapiens
uuguucauuaaaauagc

SEQ ID NO: 1152 - RNA, 17 nt, Homo sapiens
uguucauuaaaauagca

SEQ ID NO: 1153 - RNA, 17 nt, Homo sapiens
auuaaaauagcacugaa

SEQ ID NO: 1154 - RNA, 17 nt, Homo sapiens
cugaaaauugaaacaug

SEQ ID NO: 1155 - RNA, 17 nt, Homo sapiens
acaugaauuaacugaua

SEQ ID NO: 1156 - RNA, 17 nt, Homo sapiens
caugaauuaacugauaa

SEQ ID NO: 1157 - RNA, 17 nt, Homo sapiens
uaacugauaauauucca

SEQ ID NO: 1158 - RNA, 17 nt, Homo sapiens
cugauaauauuccaauc

SEQ ID NO: 1159 - RNA, 17 nt, Homo sapiens
gauaauauuccaaucau

SEQ ID NO: 1160 - RNA, 17 nt, Homo sapiens
auaauauuccaaucauu

SEQ ID NO: 1161 - RNA, 17 nt, Homo sapiens
auuccaaucauuugcca

SEQ ID NO: 1162 - RNA, 17 nt, Homo sapiens
ccaaucauuugccauuu

SEQ ID NO: 1163 - RNA, 17 nt, Homo sapiens
caaucauuugccauuua

SEQ ID NO: 1164 - RNA, 17 nt, Homo sapiens
uuugccauuuaugacaa

SEQ ID NO: 1165 - RNA, 17 nt, Homo sapiens
uugccauuuaugacaaa

SEQ ID NO: 1166 - RNA, 17 nt, Homo sapiens
ugccauuuaugacaaaa

SEQ ID NO: 1167 - RNA, 17 nt, Homo sapiens
aaaaugguuggcacuaa

SEQ ID NO: 1168 - RNA, 17 nt, Homo sapiens
uuggcacuaacaaagaa

SEQ ID NO: 1169 - RNA, 17 nt, Homo sapiens
cgagcacuuccuuucag

SEQ ID NO: 1170 - RNA, 17 nt, Homo sapiens
gagcacuuccuuucaga

SEQ ID NO: 1171 - RNA, 17 nt, Homo sapiens
cacuuccuuucagaguu

SEQ ID NO: 1172 - RNA, 17 nt, Homo sapiens
acuuccuuucagaguuu

SEQ ID NO: 1173 - RNA, 17 nt, Homo sapiens
cuuccuuucagaguuuc

SEQ ID NO: 1174 - RNA, 17 nt, Homo sapiens
uucagaguuucugagau

SEQ ID NO: 1175 - RNA, 17 nt, Homo sapiens
ucagaguuucugagaua

SEQ ID NO: 1176 - RNA, 17 nt, Homo sapiens
cagaguuucugagauaa

SEQ ID NO: 1177 - RNA, 17 nt, Homo sapiens
ucugagauaauguacgu

SEQ ID NO: 1178 - RNA, 17 nt, Homo sapiens
gauaauguacguggaac

SEQ ID NO: 1179 - RNA, 17 nt, Homo sapiens
ggaacagucugggugga

SEQ ID NO: 1180 - RNA, 17 nt, Homo sapiens
gugcaagucugugucuu

SEQ ID NO: 1181 - RNA, 17 nt, Homo sapiens
gucugugucuugucagu

SEQ ID NO: 1182 - RNA, 17 nt, Homo sapiens
cugugucuugucagucc

SEQ ID NO: 1183 - RNA, 17 nt, Homo sapiens
ugucuugucaguccaag

SEQ ID NO: 1184 - RNA, 17 nt, Homo sapiens
uugucaguccaagaagu

SEQ ID NO: 1185 - RNA, 17 nt, Homo sapiens
cgagauguuaauuuuag

SEQ ID NO: 1186 - RNA, 17 nt, Homo sapiens
gagauguuaauuuuagg

SEQ ID NO: 1187 - RNA, 17 nt, Homo sapiens
auguuaauuuuagggac

SEQ ID NO: 1188 - RNA, 17 nt, Homo sapiens
uguuaauuuuagggacc

SEQ ID NO: 1189 - RNA, 17 nt, Homo sapiens
guuaauuuuagggaccc

SEQ ID NO: 1190 - RNA, 17 nt, Homo sapiens
uuaauuuuagggacccg

SEQ ID NO: 1191 - RNA, 17 nt, Homo sapiens
ccgugccuuguuuccua

SEQ ID NO: 1192 - RNA, 17 nt, Homo sapiens
ugccuuguuuccuagcc

SEQ ID NO: 1193 - RNA, 17 nt, Homo sapiens
gccuuguuuccuagccc

SEQ ID NO: 1194 - RNA, 17 nt, Homo sapiens
ccuuguuuccuagccca

SEQ ID NO: 1195 - RNA, 17 nt, Homo sapiens
uguuuccuagcccacaa

SEQ ID NO: 1196 - RNA, 17 nt, Homo sapiens
gcaaacaucaaacagau

SEQ ID NO: 1197 - RNA, 17 nt, Homo sapiens
aaacagauacucgcuag

SEQ ID NO: 1198 - RNA, 17 nt, Homo sapiens
cagauacucgcuagccu

SEQ ID NO: 1199 - RNA, 17 nt, Homo sapiens
uacucgcuagccucauu

SEQ ID NO: 1200 - RNA, 17 nt, Homo sapiens
gcuagccucauuuaaau

SEQ ID NO: 1201 - RNA, 17 nt, Homo sapiens
agccucauuuaaauuga

SEQ ID NO: 1202 - RNA, 17 nt, Homo sapiens
gccucauuuaaauugau

SEQ ID NO: 1203 - RNA, 17 nt, Homo sapiens
ccucauuuaaauugauu

SEQ ID NO: 1204 - RNA, 17 nt, Homo sapiens
auuuaaauugauuaaag

SEQ ID NO: 1205 - RNA, 17 nt, Homo sapiens
aaauugauuaaaggagg

SEQ ID NO: 1206 - RNA, 17 nt, Homo sapiens
aauugauuaaaggagga

SEQ ID NO: 1207 - RNA, 17 nt, Homo sapiens
gagugcaucuuuggccg

SEQ ID NO: 1208 - RNA, 17 nt, Homo sapiens
gugcaucuuuggccgac

SEQ ID NO: 1209 - RNA, 17 nt, Homo sapiens
ugcaucuuuggccgaca

SEQ ID NO: 1210 - RNA, 17 nt, Homo sapiens
agugguguaacugugug

SEQ ID NO: 1211 - RNA, 17 nt, Homo sapiens
guggguguauguguguu

SEQ ID NO: 1212 - RNA, 17 nt, Homo sapiens
auguguguuuugugcau

SEQ ID NO: 1213 - RNA, 17 nt, Homo sapiens
uguguguuuugugcaua

SEQ ID NO: 1214 - RNA, 17 nt, Homo sapiens
guguguuuugugcauaa

SEQ ID NO: 1215 - RNA, 17 nt, Homo sapiens
uugugcauaacuauuua

SEQ ID NO: 1216 - RNA, 17 nt, Homo sapiens
gcauaacuauuuaagga

SEQ ID NO: 1217 - RNA, 17 nt, Homo sapiens
auaacuauuuaaggaaa

SEQ ID NO: 1218 - RNA, 17 nt, Homo sapiens
uaacuauuuaaggaaac

SEQ ID NO: 1219 - RNA, 17 nt, Homo sapiens
aacuauuuaaggaaacu

SEQ ID NO: 1220 - RNA, 17 nt, Homo sapiens
acuggaauuuuaaaguu

SEQ ID NO: 1221 - RNA, 17 nt, Homo sapiens
cuggaauuuuaaaguua

SEQ ID NO: 1222 - RNA, 17 nt, Homo sapiens
uggaauuuuaaaguuac

SEQ ID NO: 1223 - RNA, 17 nt, Homo sapiens
ggaauuuuaaaguuacu

SEQ ID NO: 1224 - RNA, 17 nt, Homo sapiens
uuuaaaguuacuuuuau

SEQ ID NO: 1225 - RNA, 17 nt, Homo sapiens
uuaaaguuacuuuuaua

SEQ ID NO: 1226 - RNA, 17 nt, Homo sapiens
aaguuacuuuuauacaa

SEQ ID NO: 1227 - RNA, 17 nt, Homo sapiens
aguuacuuuuauacaaa

SEQ ID NO: 1228 - RNA, 17 nt, Homo sapiens
guuacuuuuauacaaac

SEQ ID NO: 1229 - RNA, 17 nt, Homo sapiens
uuacuuuuauacaaacc

SEQ ID NO: 1230 - RNA, 17 nt, Homo sapiens
acuuuuauacaaaccaa

SEQ ID NO: 1231 - RNA, 17 nt, Homo sapiens
ccaagaauauaugcuac

SEQ ID NO: 1232 - RNA, 17 nt, Homo sapiens
aagaauauaugcuacag

SEQ ID NO: 1233 - RNA, 17 nt, Homo sapiens
uauaugcuacagauaua

SEQ ID NO: 1234 - RNA, 17 nt, Homo sapiens
cuacagauauaagacag

SEQ ID NO: 1235 - RNA, 17 nt, Homo sapiens
acagauauaagacagac

SEQ ID NO: 1236 - RNA, 17 nt, Homo sapiens
gacaugguuugguccua

SEQ ID NO: 1237 - RNA, 17 nt, Homo sapiens
acaugguuugguccuau

SEQ ID NO: 1238 - RNA, 17 nt, Homo sapiens
gguuugguccuauauuu

SEQ ID NO: 1239 - RNA, 17 nt, Homo sapiens
uugguccuauauuucua

SEQ ID NO: 1240 - RNA, 17 nt, Homo sapiens
gguccuauauuucuagu

SEQ ID NO: 1241 - RNA, 17 nt, Homo sapiens
uccuauauuucuaguca

SEQ ID NO: 1242 - RNA, 17 nt, Homo sapiens
ccuauauuucuagucau

SEQ ID NO: 1243 - RNA, 17 nt, Homo sapiens
cuauauuucuagucaug

SEQ ID NO: 1244 - RNA, 17 nt, Homo sapiens
auauuucuagucaugau

SEQ ID NO: 1245 - RNA, 17 nt, Homo sapiens
uuucuagucaugaugaa

SEQ ID NO: 1246 - RNA, 17 nt, Homo sapiens
augaauguauuuuguau

SEQ ID NO: 1247 - RNA, 17 nt, Homo sapiens
gaauguauuuuguauac

SEQ ID NO: 1248 - RNA, 17 nt, Homo sapiens
aauguauuuuguauacc

SEQ ID NO: 1249 - RNA, 17 nt, Homo sapiens
auguauuuuguauacca

SEQ ID NO: 1250 - RNA, 17 nt, Homo sapiens
uauuuuguauaccaucu

SEQ ID NO: 1251 - RNA, 17 nt, Homo sapiens
uuuuguauaccaucuuc

SEQ ID NO: 1252 - RNA, 17 nt, Homo sapiens
uauaccaucuucauaua

SEQ ID NO: 1253 - RNA, 17 nt, Homo sapiens
uaccaucuucauauaau

SEQ ID NO: 1254 - RNA, 17 nt, Homo sapiens
accaucuucauauaaua

SEQ ID NO: 1255 - RNA, 17 nt, Homo sapiens
aucuucauauaauauac

SEQ ID NO: 1256 - RNA, 17 nt, Homo sapiens
cuucauauaauauacuu

SEQ ID NO: 1257 - RNA, 17 nt, Homo sapiens
cauauaauauacuuaaa

SEQ ID NO: 1258 - RNA, 17 nt, Homo sapiens
uauaauauacuuaaaaa

SEQ ID NO: 1259 - RNA, 17 nt, Homo sapiens
aauauacuuaaaaauau

SEQ ID NO: 1260 - RNA, 17 nt, Homo sapiens
auauacuuaaaaauauu

SEQ ID NO: 1261 - RNA, 17 nt, Homo sapiens
uuaaaaauauuucuuaa

SEQ ID NO: 1262 - RNA, 17 nt, Homo sapiens
aaaaauauuucuuaauu

SEQ ID NO: 1263 - RNA, 17 nt, Homo sapiens
aaaauauuucuuaauug

SEQ ID NO: 1264 - RNA, 17 nt, Homo sapiens
aaauauuucuuaauugg

SEQ ID NO: 1265 - RNA, 17 nt, Homo sapiens
auauuucuuaauuggga

SEQ ID NO: 1266 - RNA, 17 nt, Homo sapiens
uauuucuuaauugggau

SEQ ID NO: 1267 - RNA, 17 nt, Homo sapiens
uucuuaauugggauuug

SEQ ID NO: 1268 - RNA, 17 nt, Homo sapiens
auugggauuuguaaucg

SEQ ID NO: 1269 - RNA, 17 nt, Homo sapiens
uugggauuuguaaucgu

SEQ ID NO: 1270 - RNA, 17 nt, Homo sapiens
ggauuuguaaucguacc

SEQ ID NO: 1271 - RNA, 17 nt, Homo sapiens
uuuguaaucguaccaac

SEQ ID NO: 1272 - RNA, 17 nt, Homo sapiens
guaaucguaccaacuua

SEQ ID NO: 1273 - RNA, 17 nt, Homo sapiens
uaccaacuuaauugaua

SEQ ID NO: 1274 - RNA, 17 nt, Homo sapiens
accaacuuaauugauaa

SEQ ID NO: 1275 - RNA, 17 nt, Homo sapiens
aacuuaauugauaaacu

SEQ ID NO: 1276 - RNA, 17 nt, Homo sapiens
uaauugauaaacuuggc

SEQ ID NO: 1277 - RNA, 17 nt, Homo sapiens
gauaaacuuggcaacug

SEQ ID NO: 1278 - RNA, 17 nt, Homo sapiens
caacugcuuuuauguuc

SEQ ID NO: 1279 - RNA, 17 nt, Homo sapiens
aacugcuuuuauguucu

SEQ ID NO: 1280 - RNA, 17 nt, Homo sapiens
acugcuuuuauguucug

SEQ ID NO: 1281 - RNA, 17 nt, Homo sapiens
cugcuuuuauguucugu

SEQ ID NO: 1282 - RNA, 17 nt, Homo sapiens
uuuuauguucugucucc

SEQ ID NO: 1283 - RNA, 17 nt, Homo sapiens
uuuauguucugucuccu

SEQ ID NO: 1284 - RNA, 17 nt, Homo sapiens
uguucugucuccuucca

SEQ ID NO: 1285 - RNA, 17 nt, Homo sapiens
uucugucuccuuccaua

SEQ ID NO: 1286 - RNA, 17 nt, Homo sapiens
ugucuccuuccauaaau

SEQ ID NO: 1287 - RNA, 17 nt, Homo sapiens
gucuccuuccauaaauu

SEQ ID NO: 1288 - RNA, 17 nt, Homo sapiens
ccuuccauaaauuuuuc

SEQ ID NO: 1289 - RNA, 17 nt, Homo sapiens
ccauaaauuuuucaaaa

SEQ ID NO: 1290 - RNA, 17 nt, Homo sapiens
cauaaauuuuucaaaau

SEQ ID NO: 1291 - RNA, 17 nt, Homo sapiens
auaaauuuuucaaaaua

SEQ ID NO: 1292 - RNA, 17 nt, Homo sapiens
uaaauuuuucaaaauac

SEQ ID NO: 1293 - RNA, 17 nt, Homo sapiens
aaauuuuucaaaauacu

SEQ ID NO: 1294 - RNA, 17 nt, Homo sapiens
uucaaaauacuaauuca

SEQ ID NO: 1295 - RNA, 17 nt, Homo sapiens
aaaauacuaauucaaca

SEQ ID NO: 1296 - RNA, 17 nt, Homo sapiens
auacuaauucaacaaag

SEQ ID NO: 1297 - RNA, 17 nt, Homo sapiens
uacuaauucaacaaaga

SEQ ID NO: 1298 - RNA, 17 nt, Homo sapiens
aaaaagcucuuuuuuuu

SEQ ID NO: 1299 - RNA, 17 nt, Homo sapiens
aaagcucuuuuuuuucc

SEQ ID NO: 1300 - RNA, 17 nt, Homo sapiens
aagcucuuuuuuuuccu

SEQ ID NO: 1301 - RNA, 17 nt, Homo sapiens
agcucuuuuuuuuccua

SEQ ID NO: 1302 - RNA, 17 nt, Homo sapiens
gcucuuuuuuuuccuaa

SEQ ID NO: 1303 - RNA, 17 nt, Homo sapiens
cucuuuuuuuuccuaaa

SEQ ID NO: 1304 - RNA, 17 nt, Homo sapiens
ucuuuuuuuuccuaaaa

SEQ ID NO: 1305 - RNA, 17 nt, Homo sapiens
cuuuuuuuuccuaaaau

SEQ ID NO: 1306 - RNA, 17 nt, Homo sapiens
uuuuuuuuccuaaaaua

SEQ ID NO: 1307 - RNA, 17 nt, Homo sapiens
uuuuuccuaaaauaaac

SEQ ID NO: 1308 - RNA, 17 nt, Homo sapiens
ccuaaaauaaacucaaa

SEQ ID NO: 1309 - RNA, 17 nt, Homo sapiens
aauaaacucaaauuuau

SEQ ID NO: 1310 - RNA, 17 nt, Homo sapiens
acucaaauuuauccuug

SEQ ID NO: 1311 - RNA, 17 nt, Homo sapiens
cucaaauuuauccuugu

SEQ ID NO: 1312 - RNA, 17 nt, Homo sapiens
ucaaauuuauccuuguu

SEQ ID NO: 1313 - RNA, 17 nt, Homo sapiens
aaauuuauccuuguuua

SEQ ID NO: 1314 - RNA, 17 nt, Homo sapiens
uuuauccuuguuuagag

SEQ ID NO: 1315 - RNA, 17 nt, Homo sapiens
auccuuguuuagagcag

SEQ ID NO: 1316 - RNA, 17 nt, Homo sapiens
uccuuguuuagagcaga

SEQ ID NO: 1317 - RNA, 17 nt, Homo sapiens
ccuuguuuagagcagag

SEQ ID NO: 1318 - RNA, 17 nt, Homo sapiens
agaaaaauuaagaaaaa

SEQ ID NO: 1319 - RNA, 17 nt, Homo sapiens
gaaaaauuaagaaaaac

SEQ ID NO: 1320 - RNA, 17 nt, Homo sapiens
gaaaaacuuugaaaugg

SEQ ID NO: 1321 - RNA, 17 nt, Homo sapiens
aaaaacuuugaaauggu

SEQ ID NO: 1322 - RNA, 17 nt, Homo sapiens
gaaauggucucaaaaaa

SEQ ID NO: 1323 - RNA, 17 nt, Homo sapiens
aauggucucaaaaaauu

SEQ ID NO: 1324 - RNA, 17 nt, Homo sapiens
caaaaaauugcuaaaua

SEQ ID NO: 1325 - RNA, 17 nt, Homo sapiens
aaauugcuaaauauuuu

SEQ ID NO: 1326 - RNA, 17 nt, Homo sapiens
ugcuaaauauuuucaau

SEQ ID NO: 1327 - RNA, 17 nt, Homo sapiens
cuaaauauuuucaaugg

SEQ ID NO: 1328 - RNA, 17 nt, Homo sapiens
uaaauauuuucaaugga

SEQ ID NO: 1329 - RNA, 17 nt, Homo sapiens
aaauauuuucaauggaa

SEQ ID NO: 1330 - RNA, 17 nt, Homo sapiens
aauauuuucaauggaaa

SEQ ID NO: 1331 - RNA, 17 nt, Homo sapiens
ggaaaacuaaauguuag

SEQ ID NO: 1332 - RNA, 17 nt, Homo sapiens
cuaaauguuaguuuagc

SEQ ID NO: 1333 - RNA, 17 nt, Homo sapiens
uaaauguuaguuuagcu

SEQ ID NO: 1334 - RNA, 17 nt, Homo sapiens
auguuaguuuagcugau

SEQ ID NO: 1335 - RNA, 17 nt, Homo sapiens
uguuaguuuagcugauu

SEQ ID NO: 1336 - RNA, 17 nt, Homo sapiens
guuaguuuagcugauug

SEQ ID NO: 1337 - RNA, 17 nt, Homo sapiens
uagcugauuguaugggg

SEQ ID NO: 1338 - RNA, 17 nt, Homo sapiens
cugauuguaugggguuu

SEQ ID NO: 1339 - RNA, 17 nt, Homo sapiens
uaugggguuuucgaacc

SEQ ID NO: 1340 - RNA, 17 nt, Homo sapiens
augggguuuucgaaccu

SEQ ID NO: 1341 - RNA, 17 nt, Homo sapiens
ugggguuuucgaaccuu

SEQ ID NO: 1342 - RNA, 17 nt, Homo sapiens
gggguuuucgaaccuuu

SEQ ID NO: 1343 - RNA, 17 nt, Homo sapiens
ucgaaccuuucacuuuu

SEQ ID NO: 1344 - RNA, 17 nt, Homo sapiens
cgaaccuuucacuuuuu

SEQ ID NO: 1345 - RNA, 17 nt, Homo sapiens
gaaccuuucacuuuuug

SEQ ID NO: 1346 - RNA, 17 nt, Homo sapiens
cuuucacuuuuuguuug

SEQ ID NO: 1347 - RNA, 17 nt, Homo sapiens
uuucacuuuuuguuugu

SEQ ID NO: 1348 - RNA, 17 nt, Homo sapiens
uucacuuuuuguuuguu

SEQ ID NO: 1349 - RNA, 17 nt, Homo sapiens
ucacuuuuuguuuguuu

SEQ ID NO: 1350 - RNA, 17 nt, Homo sapiens
cuuuuuguuuguuuuac

SEQ ID NO: 1351 - RNA, 17 nt, Homo sapiens
uuuuuguuuguuuuacc

SEQ ID NO: 1352 - RNA, 17 nt, Homo sapiens
uuguuuguuuuaccuau

SEQ ID NO: 1353 - RNA, 17 nt, Homo sapiens
uguuuguuuuaccuauu

SEQ ID NO: 1354 - RNA, 17 nt, Homo sapiens
guuuguuuuaccuauuu

SEQ ID NO: 1355 - RNA, 17 nt, Homo sapiens
uuuguuuuaccuauuuc

SEQ ID NO: 1356 - RNA, 17 nt, Homo sapiens
uuuuaccuauuucacaa

SEQ ID NO: 1357 - RNA, 17 nt, Homo sapiens
uuaccuauuucacaacu

SEQ ID NO: 1358 - RNA, 17 nt, Homo sapiens
uaccuauuucacaacug

SEQ ID NO: 1359 - RNA, 17 nt, Homo sapiens
accuauuucacaacugu

SEQ ID NO: 1360 - RNA, 17 nt, Homo sapiens
aacuguguaaauugcca

SEQ ID NO: 1361 - RNA, 17 nt, Homo sapiens
guguaaauugccaauaa

SEQ ID NO: 1362 - RNA, 17 nt, Homo sapiens
uugccaauaauuccugu

SEQ ID NO: 1363 - RNA, 17 nt, Homo sapiens
ccaauaauuccugucca

SEQ ID NO: 1364 - RNA, 17 nt, Homo sapiens
caauaauuccuguccau

SEQ ID NO: 1365 - RNA, 17 nt, Homo sapiens
auuccuguccaugaaaa

SEQ ID NO: 1366 - RNA, 17 nt, Homo sapiens
augcaaauuauccagug

SEQ ID NO: 1367 - RNA, 17 nt, Homo sapiens
ugcaaauuauccagugu

SEQ ID NO: 1368 - RNA, 17 nt, Homo sapiens
caaauuauccaguguag

SEQ ID NO: 1369 - RNA, 17 nt, Homo sapiens
uccaguguagauauauu

SEQ ID NO: 1370 - RNA, 17 nt, Homo sapiens
guguagauauauuugac

SEQ ID NO: 1371 - RNA, 17 nt, Homo sapiens
guagauauauuugacca

SEQ ID NO: 1372 - RNA, 17 nt, Homo sapiens
agauauauuugaccauc

SEQ ID NO: 1373 - RNA, 17 nt, Homo sapiens
gauauauuugaccauca

SEQ ID NO: 1374 - RNA, 17 nt, Homo sapiens
uugaccaucacccuaug

SEQ ID NO: 1375 - RNA, 17 nt, Homo sapiens
aucacccuauggauauu

SEQ ID NO: 1376 - RNA, 17 nt, Homo sapiens
cuauggauauuggcuag

SEQ ID NO: 1377 - RNA, 17 nt, Homo sapiens
auggauauuggcuaguu

SEQ ID NO: 1378 - RNA, 17 nt, Homo sapiens
uauuggcuaguuuugcc

SEQ ID NO: 1379 - RNA, 17 nt, Homo sapiens
uggcuaguuuugccuuu

SEQ ID NO: 1380 - RNA, 17 nt, Homo sapiens
ggcuaguuuugccuuua

SEQ ID NO: 1381 - RNA, 17 nt, Homo sapiens
gcuaguuuugccuuuau

SEQ ID NO: 1382 - RNA, 17 nt, Homo sapiens
uuuugccuuuauuaagc

SEQ ID NO: 1383 - RNA, 17 nt, Homo sapiens
uuugccuuuauuaagca

SEQ ID NO: 1384 - RNA, 17 nt, Homo sapiens
uugccuuuauuaagcaa

SEQ ID NO: 1385 - RNA, 17 nt, Homo sapiens
gccuuuauuaagcaaau

SEQ ID NO: 1386 - RNA, 17 nt, Homo sapiens
ccuuuauuaagcaaauu

SEQ ID NO: 1387 - RNA, 17 nt, Homo sapiens
aagcaaauucauuucag

SEQ ID NO: 1388 - RNA, 17 nt, Homo sapiens
agcaaauucauuucagc

SEQ ID NO: 1389 - RNA, 17 nt, Homo sapiens
aaauucauuucagccug

SEQ ID NO: 1390 - RNA, 17 nt, Homo sapiens
aauucauuucagccuga

SEQ ID NO: 1391 - RNA, 17 nt, Homo sapiens
auucauuucagccugaa

SEQ ID NO: 1392 - RNA, 17 nt, Homo sapiens
cugaaugucugccuaua

SEQ ID NO: 1393 - RNA, 17 nt, Homo sapiens
gucugccuauauauucu

SEQ ID NO: 1394 - RNA, 17 nt, Homo sapiens
cugccuauauauucucu

SEQ ID NO: 1395 - RNA, 17 nt, Homo sapiens
gccuauauauucucugc

SEQ ID NO: 1396 - RNA, 17 nt, Homo sapiens
cuauauauucucugcuc

SEQ ID NO: 1397 - RNA, 17 nt, Homo sapiens
uauauauucucugcucu

SEQ ID NO: 1398 - RNA, 17 nt, Homo sapiens
uauauucucugcucuuu

SEQ ID NO: 1399 - RNA, 17 nt, Homo sapiens
ucucugcucuuuguauu

SEQ ID NO: 1400 - RNA, 17 nt, Homo sapiens
ucugcucuuuguauucu

SEQ ID NO: 1401 - RNA, 17 nt, Homo sapiens
cugcucuuuguauucuc

SEQ ID NO: 1402 - RNA, 17 nt, Homo sapiens
cucuuuguauucuccuu

SEQ ID NO: 1403 - RNA, 17 nt, Homo sapiens
cuuuguauucuccuuug

SEQ ID NO: 1404 - RNA, 17 nt, Homo sapiens
uuuguauucuccuuuga

SEQ ID NO: 1405 - RNA, 17 nt, Homo sapiens
uguauucuccuuugaac

SEQ ID NO: 1406 - RNA, 17 nt, Homo sapiens
auucuccuuugaacccg

SEQ ID NO: 1407 - RNA, 17 nt, Homo sapiens
uucuccuuugaacccgu

SEQ ID NO: 1408 - RNA, 17 nt, Homo sapiens
gaacccguuaaaacauc

SEQ ID NO: 1409 - RNA, 17 nt, Homo sapiens
aacccguuaaaacaucc

SEQ ID NO: 1410 - RNA, 17 nt, Homo sapiens
uaaaacauccuguggca

SEQ ID NO: 1411 - RNA, 18 nt, Homo sapiens
ccucucggcuccuccccg

SEQ ID NO: 1412 - RNA, 18 nt, Homo sapiens
ggcggcggcucggagcgg

SEQ ID NO: 1413 - RNA, 18 nt, Homo sapiens
gaggacggacucuggcgg

SEQ ID NO: 1414 - RNA, 18 nt, Homo sapiens
ucuggcggccgggucguu

SEQ ID NO: 1415 - RNA, 18 nt, Homo sapiens
ggguccugcugugcgcgc

SEQ ID NO: 1416 - RNA, 18 nt, Homo sapiens
gcgcgcugcucagcuguc

SEQ ID NO: 1417 - RNA, 18 nt, Homo sapiens
cugcucagcugucugcuu

SEQ ID NO: 1418 - RNA, 18 nt, Homo sapiens
cucagcugucugcuucuc

SEQ ID NO: 1419 - RNA, 18 nt, Homo sapiens
gcugucugcuucucacag

SEQ ID NO: 1420 - RNA, 18 nt, Homo sapiens
ggaagcagcccauaaaug

SEQ ID NO: 1421 - RNA, 18 nt, Homo sapiens
uaaaucugccuguggaag

SEQ ID NO: 1422 - RNA, 18 nt, Homo sapiens
gaacacagcucaagcaaa

SEQ ID NO: 1423 - RNA, 18 nt, Homo sapiens
uucuacagcugcaaauau

SEQ ID NO: 1424 - RNA, 18 nt, Homo sapiens
auucccugccggguuacg

SEQ ID NO: 1425 - RNA, 18 nt, Homo sapiens
gaucccugauggaaaacg

SEQ ID NO: 1426 - RNA, 18 nt, Homo sapiens
ggcuucugaccugugaag

SEQ ID NO: 1427 - RNA, 18 nt, Homo sapiens
uuacccugaugaaaaaaa

SEQ ID NO: 1428 - RNA, 18 nt, Homo sapiens
gcaagcggucuuaccggc

SEQ ID NO: 1429 - RNA, 18 nt, Homo sapiens
cuuaccggcucucuauga

SEQ ID NO: 1430 - RNA, 18 nt, Homo sapiens
gaaaucugcucgcuauuu

SEQ ID NO: 1431 - RNA, 18 nt, Homo sapiens
aaccccagauuuacgaaa

SEQ ID NO: 1432 - RNA, 18 nt, Homo sapiens
guuuccagacccggcucu

SEQ ID NO: 1433 - RNA, 18 nt, Homo sapiens
agacccggcucucuaccc

SEQ ID NO: 1434 - RNA, 18 nt, Homo sapiens
aaauccugacuuguaccg

SEQ ID NO: 1435 - RNA, 18 nt, Homo sapiens
uguggcugacucuagaau

SEQ ID NO: 1436 - RNA, 18 nt, Homo sapiens
uaucacagaugugccaaa

SEQ ID NO: 1437 - RNA, 18 nt, Homo sapiens
aaaugccgacggaaggag

SEQ ID NO: 1438 - RNA, 18 nt, Homo sapiens
ugaaacugucuugcacag

SEQ ID NO: 1439 - RNA, 18 nt, Homo sapiens
aucagcaguuccaccacu

SEQ ID NO: 1440 - RNA, 18 nt, Homo sapiens
agccucagaucacuuggu

SEQ ID NO: 1441 - RNA, 18 nt, Homo sapiens
gcacgcuguuuauugaaa

SEQ ID NO: 1442 - RNA, 18 nt, Homo sapiens
ccucacuguucaaggaac

SEQ ID NO: 1443 - RNA, 18 nt, Homo sapiens
uggagcugaucacucuaa

SEQ ID NO: 1444 - RNA, 18 nt, Homo sapiens
aaagacugacuaccuauc

SEQ ID NO: 1445 - RNA, 18 nt, Homo sapiens
ggacccagaugaaguucc

SEQ ID NO: 1446 - RNA, 18 nt, Homo sapiens
gugagcggcucccuuaug

SEQ ID NO: 1447 - RNA, 18 nt, Homo sapiens
cgugccggacuguggcug

SEQ ID NO: 1448 - RNA, 18 nt, Homo sapiens
aagcucugaugacugagc

SEQ ID NO: 1449 - RNA, 18 nt, Homo sapiens
uuaaccugcugggagccu

SEQ ID NO: 1450 - RNA, 18 nt, Homo sapiens
ggccucugauggugauug

SEQ ID NO: 1451 - RNA, 18 nt, Homo sapiens
agcuccggcuuucaggaa

SEQ ID NO: 1452 - RNA, 18 nt, Homo sapiens
ggauucugacgguuucua

SEQ ID NO: 1453 - RNA, 18 nt, Homo sapiens
ucugacgguuucuacaag

SEQ ID NO: 1454 - RNA, 18 nt, Homo sapiens
aagaucugauuucuuaca

SEQ ID NO: 1455 - RNA, 18 nt, Homo sapiens
ucuuacaguuuucaagug

SEQ ID NO: 1456 - RNA, 18 nt, Homo sapiens
aguuccugucuuccagaa

SEQ ID NO: 1457 - RNA, 18 nt, Homo sapiens
gaaccccgauuaugugag

SEQ ID NO: 1458 - RNA, 18 nt, Homo sapiens
uuuugcagucgccugagg

SEQ ID NO: 1459 - RNA, 18 nt, Homo sapiens
ucuaucagaucaugcugg

SEQ ID NO: 1460 - RNA, 18 nt, Homo sapiens
cuggacugcuggcacaga

SEQ ID NO: 1461 - RNA, 18 nt, Homo sapiens
aacuccugccuucucuga

SEQ ID NO: 1462 - RNA, 18 nt, Homo sapiens
uauuucagcuccgaaguu

SEQ ID NO: 1463 - RNA, 18 nt, Homo sapiens
aagcucugaugaugucag

SEQ ID NO: 1464 - RNA, 18 nt, Homo sapiens
gcacucuguuggccucuc

SEQ ID NO: 1465 - RNA, 18 nt, Homo sapiens
cggggcugucugauguca

SEQ ID NO: 1466 - RNA, 18 nt, Homo sapiens
gcugucugaugucagcag

SEQ ID NO: 1467 - RNA, 18 nt, Homo sapiens
aggcccaguuucugccau

SEQ ID NO: 1468 - RNA, 18 nt, Homo sapiens
cauuccagcugugggcac

SEQ ID NO: 1469 - RNA, 18 nt, Homo sapiens
gcgugcugcuccccgccc

SEQ ID NO: 1470 - RNA, 18 nt, Homo sapiens
gcuccccgcccccagacu

SEQ ID NO: 1471 - RNA, 18 nt, Homo sapiens
gcccccagacuacaacuc

SEQ ID NO: 1472 - RNA, 18 nt, Homo sapiens
ggagccagcugcuuuuug

SEQ ID NO: 1473 - RNA, 18 nt, Homo sapiens
gccagcugcuuuuuguga

SEQ ID NO: 1474 - RNA, 18 nt, Homo sapiens
cuucccugcuccaacccc

SEQ ID NO: 1475 - RNA, 18 nt, Homo sapiens
aggaccaguuugauugag

SEQ ID NO: 1476 - RNA, 18 nt, Homo sapiens
cugcacugaucacccaau

SEQ ID NO: 1477 - RNA, 18 nt, Homo sapiens
ugggccagcccugcagcc

SEQ ID NO: 1478 - RNA, 18 nt, Homo sapiens
cccugcagcccaaaaccc

SEQ ID NO: 1479 - RNA, 18 nt, Homo sapiens
cuucccagcucugacccu

SEQ ID NO: 1480 - RNA, 18 nt, Homo sapiens
cagcucugacccuucuac

SEQ ID NO: 1481 - RNA, 18 nt, Homo sapiens
aggagcagauggacagcg

SEQ ID NO: 1482 - RNA, 18 nt, Homo sapiens
uuauucuguuuugcacag

SEQ ID NO: 1483 - RNA, 18 nt, Homo sapiens
aaaugcaguccugaggag

SEQ ID NO: 1484 - RNA, 18 nt, Homo sapiens
gagggcugauggaggaaa

SEQ ID NO: 1485 - RNA, 18 nt, Homo sapiens
agaccccgucucuauacc

SEQ ID NO: 1486 - RNA, 18 nt, Homo sapiens
caacacaguugggaccca

SEQ ID NO: 1487 - RNA, 18 nt, Homo sapiens
uucuccaguugggacuca

SEQ ID NO: 1488 - RNA, 18 nt, Homo sapiens
uucaacugcuuugaaacu

SEQ ID NO: 1489 - RNA, 18 nt, Homo sapiens
uggcucuguuugaugcua

SEQ ID NO: 1490 - RNA, 18 nt, Homo sapiens
gauugcugcuucuugggg

SEQ ID NO: 1491 - RNA, 18 nt, Homo sapiens
ugccucuguucuuaugug

SEQ ID NO: 1492 - RNA, 18 nt, Homo sapiens
ggcagcggcuuuugugga

SEQ ID NO: 1493 - RNA, 18 nt, Homo sapiens
ugggacaguccucuccac

SEQ ID NO: 1494 - RNA, 18 nt, Homo sapiens
ugugacagcuggcaauuu

SEQ ID NO: 1495 - RNA, 18 nt, Homo sapiens
cuuagcuguucaugucuu

SEQ ID NO: 1496 - RNA, 18 nt, Homo sapiens
uuacucagcuccuucaaa

SEQ ID NO: 1497 - RNA, 18 nt, Homo sapiens
uggaacagucugggugga

SEQ ID NO: 1498 - RNA, 18 nt, Homo sapiens
cuugucaguccaagaagu

SEQ ID NO: 1499 - RNA, 18 nt, Homo sapiens
ggcaacugcuuuuauguu

SEQ ID NO: 1500 - RNA, 18 nt, Homo sapiens
auguucugucuccuucca

SEQ ID NO: 1501 - RNA, 18 nt, Homo sapiens
uuuagcugauuguauggg

SEQ ID NO: 1502 - RNA, 18 nt, Homo sapiens
aauuccuguccaugaaaa

SEQ ID NO: 1503 - RNA, 18 nt, Homo sapiens
cauuucagccugaauguc

SEQ ID NO: 1504 - RNA, 18 nt, Homo sapiens
aaugucugccuauauauu

SEQ ID NO: 1505 - RNA, 18 nt, Homo sapiens
auucucugcucuuuguau

SEQ ID NO: 1506 - RNA, 17 nt, Homo sapiens
cuggccgucgcccugug

SEQ ID NO: 1507 - RNA, 17 nt, Homo sapiens
cuguggcucugcgugga

SEQ ID NO: 1508 - RNA, 17 nt, Homo sapiens
ggccgccucuguggguu

SEQ ID NO: 1509 - RNA, 17 nt, Homo sapiens
cuguggguuugccuagu

SEQ ID NO: 1510 - RNA, 17 nt, Homo sapiens
uguggguuugccuagug

SEQ ID NO: 1511 - RNA, 17 nt, Homo sapiens
guuugccuaguguuucu

SEQ ID NO: 1512 - RNA, 17 nt, Homo sapiens
ccuaguguuucucuuga

SEQ ID NO: 1513 - RNA, 17 nt, Homo sapiens
cuaguguuucucuugau

SEQ ID NO: 1514 - RNA, 17 nt, Homo sapiens
uaguguuucucuugauc

SEQ ID NO: 1515 - RNA, 17 nt, Homo sapiens
guguuucucuugaucug

SEQ ID NO: 1516 - RNA, 17 nt, Homo sapiens
guuucucuugaucugcc

SEQ ID NO: 1517 - RNA, 17 nt, Homo sapiens
cucuugaucugcccagg

SEQ ID NO: 1518 - RNA, 17 nt, Homo sapiens
cccaggcucagcauaca

SEQ ID NO: 1519 - RNA, 17 nt, Homo sapiens
cucagcauacaaaaaga

SEQ ID NO: 1520 - RNA, 17 nt, Homo sapiens
aaagacauacuuacaau

SEQ ID NO: 1521 - RNA, 17 nt, Homo sapiens
gacauacuuacaauuaa

SEQ ID NO: 1522 - RNA, 17 nt, Homo sapiens
acauacuuacaauuaag

SEQ ID NO: 1523 - RNA, 17 nt, Homo sapiens
cuuacaauuaaggcuaa

SEQ ID NO: 1524 - RNA, 17 nt, Homo sapiens
uuacaauuaaggcuaau

SEQ ID NO: 1525 - RNA, 17 nt, Homo sapiens
uuaaggcuaauacaacu

SEQ ID NO: 1526 - RNA, 17 nt, Homo sapiens
aggcuaauacaacucuu

SEQ ID NO: 1527 - RNA, 17 nt, Homo sapiens
auacaacucuucaaauu

SEQ ID NO: 1528 - RNA, 17 nt, Homo sapiens
acaacucuucaaauuac

SEQ ID NO: 1529 - RNA, 17 nt, Homo sapiens
caacucuucaaauuacu

SEQ ID NO: 1530 - RNA, 17 nt, Homo sapiens
cuucaaauuacuugcag

SEQ ID NO: 1531 - RNA, 17 nt, Homo sapiens
uucaaauuacuugcagg

SEQ ID NO: 1532 - RNA, 17 nt, Homo sapiens
aaauuacuugcagggga

SEQ ID NO: 1533 - RNA, 17 nt, Homo sapiens
gagggacuuggacuggc

SEQ ID NO: 1534 - RNA, 17 nt, Homo sapiens
gacuggcuuuggcccaa

SEQ ID NO: 1535 - RNA, 17 nt, Homo sapiens
acuggcuuuggcccaau

SEQ ID NO: 1536 - RNA, 17 nt, Homo sapiens
ggcccaauaaucagagu

SEQ ID NO: 1537 - RNA, 17 nt, Homo sapiens
ccaauaaucagaguggc

SEQ ID NO: 1538 - RNA, 17 nt, Homo sapiens
gauggccucuucuguaa

SEQ ID NO: 1539 - RNA, 17 nt, Homo sapiens
uggccucuucuguaaga

SEQ ID NO: 1540 - RNA, 17 nt, Homo sapiens
ggccucuucuguaagac

SEQ ID NO: 1541 - RNA, 17 nt, Homo sapiens
ucuucuguaagacacuc

SEQ ID NO: 1542 - RNA, 17 nt, Homo sapiens
aagacacucacaauucc

SEQ ID NO: 1543 - RNA, 17 nt, Homo sapiens
cucacaauuccaaaagu

SEQ ID NO: 1544 - RNA, 17 nt, Homo sapiens
ucacaauuccaaaagug

SEQ ID NO: 1545 - RNA, 17 nt, Homo sapiens
aaagugaucggaaauga

SEQ ID NO: 1546 - RNA, 17 nt, Homo sapiens
uggagccuacaagugcu

SEQ ID NO: 1547 - RNA, 17 nt, Homo sapiens
caagugcuucuaccggg

SEQ ID NO: 1548 - RNA, 17 nt, Homo sapiens
aagugcuucuaccggga

SEQ ID NO: 1549 - RNA, 17 nt, Homo sapiens
gugcuucuaccgggaaa

SEQ ID NO: 1550 - RNA, 17 nt, Homo sapiens
aacugacuuggccucgg

SEQ ID NO: 1551 - RNA, 17 nt, Homo sapiens
cuuggccucggucauuu

SEQ ID NO: 1552 - RNA, 17 nt, Homo sapiens
gccucggucauuuaugu

SEQ ID NO: 1553 - RNA, 17 nt, Homo sapiens
ucggucauuuaugucua

SEQ ID NO: 1554 - RNA, 17 nt, Homo sapiens
cggucauuuaugucuau

SEQ ID NO: 1555 - RNA, 17 nt, Homo sapiens
ggucauuuaugucuaug

SEQ ID NO: 1556 - RNA, 17 nt, Homo sapiens
auuuaugucuauguuca

SEQ ID NO: 1557 - RNA, 17 nt, Homo sapiens
uuaugucuauguucaag

SEQ ID NO: 1558 - RNA, 17 nt, Homo sapiens
gucuauguucaagauua

SEQ ID NO: 1559 - RNA, 17 nt, Homo sapiens
ucuauguucaagauuac

SEQ ID NO: 1560 - RNA, 17 nt, Homo sapiens
uucaagauuacagaucu

SEQ ID NO: 1561 - RNA, 17 nt, Homo sapiens
ucaagauuacagaucuc

SEQ ID NO: 1562 - RNA, 17 nt, Homo sapiens
uuacagaucuccauuua

SEQ ID NO: 1563 - RNA, 17 nt, Homo sapiens
acagaucuccauuuauu

SEQ ID NO: 1564 - RNA, 17 nt, Homo sapiens
aucuccauuuauugcuu

SEQ ID NO: 1565 - RNA, 17 nt, Homo sapiens
ucuccauuuauugcuuc

SEQ ID NO: 1566 - RNA, 17 nt, Homo sapiens
cuccauuuauugcuucu

SEQ ID NO: 1567 - RNA, 17 nt, Homo sapiens
ccauuuauugcuucugu

SEQ ID NO: 1568 - RNA, 17 nt, Homo sapiens
uuauugcuucuguuagu

SEQ ID NO: 1569 - RNA, 17 nt, Homo sapiens
uauugcuucuguuagug

SEQ ID NO: 1570 - RNA, 17 nt, Homo sapiens
gcuucuguuagugacca

SEQ ID NO: 1571 - RNA, 17 nt, Homo sapiens
cuucuguuagugaccaa

SEQ ID NO: 1572 - RNA, 17 nt, Homo sapiens
cauggagucguguacau

SEQ ID NO: 1573 - RNA, 17 nt, Homo sapiens
agucguguacauuacug

SEQ ID NO: 1574 - RNA, 17 nt, Homo sapiens
guguacauuacugagaa

SEQ ID NO: 1575 - RNA, 17 nt, Homo sapiens
uguacauuacugagaac

SEQ ID NO: 1576 - RNA, 17 nt, Homo sapiens
guggugauuccaugucu

SEQ ID NO: 1577 - RNA, 17 nt, Homo sapiens
uggugauuccaugucuc

SEQ ID NO: 1578 - RNA, 17 nt, Homo sapiens
uuccaugucucgggucc

SEQ ID NO: 1579 - RNA, 17 nt, Homo sapiens
ccaugucucggguccau

SEQ ID NO: 1580 - RNA, 17 nt, Homo sapiens
ucucggguccauuucaa

SEQ ID NO: 1581 - RNA, 17 nt, Homo sapiens
ggguccauuucaaaucu

SEQ ID NO: 1582 - RNA, 17 nt, Homo sapiens
gguccauuucaaaucuc

SEQ ID NO: 1583 - RNA, 17 nt, Homo sapiens
guccauuucaaaucuca

SEQ ID NO: 1584 - RNA, 17 nt, Homo sapiens
uuucaaaucucaacgug

SEQ ID NO: 1585 - RNA, 17 nt, Homo sapiens
ucaaaucucaacguguc

SEQ ID NO: 1586 - RNA, 17 nt, Homo sapiens
caacgugucacuuugug

SEQ ID NO: 1587 - RNA, 17 nt, Homo sapiens
gugucacuuugugcaag

SEQ ID NO: 1588 - RNA, 17 nt, Homo sapiens
ugucacuuugugcaaga

SEQ ID NO: 1589 - RNA, 17 nt, Homo sapiens
ugcaagauacccagaaa

SEQ ID NO: 1590 - RNA, 17 nt, Homo sapiens
aaagagauuuguuccug

SEQ ID NO: 1591 - RNA, 17 nt, Homo sapiens
aagagauuuguuccuga

SEQ ID NO: 1592 - RNA, 17 nt, Homo sapiens
agauuuguuccugaugg

SEQ ID NO: 1593 - RNA, 17 nt, Homo sapiens
gauuuguuccugauggu

SEQ ID NO: 1594 - RNA, 17 nt, Homo sapiens
cugaugguaacagaauu

SEQ ID NO: 1595 - RNA, 17 nt, Homo sapiens
aacagaauuuccuggga

SEQ ID NO: 1596 - RNA, 17 nt, Homo sapiens
acagaauuuccugggac

SEQ ID NO: 1597 - RNA, 17 nt, Homo sapiens
cagaauuuccugggaca

SEQ ID NO: 1598 - RNA, 17 nt, Homo sapiens
gaagggcuuuacuauuc

SEQ ID NO: 1599 - RNA, 17 nt, Homo sapiens
aagggcuuuacuauucc

SEQ ID NO: 1600 - RNA, 17 nt, Homo sapiens
agggcuuuacuauuccc

SEQ ID NO: 1601 - RNA, 17 nt, Homo sapiens
gcuuuacuauucccagc

SEQ ID NO: 1602 - RNA, 17 nt, Homo sapiens
uuuacuauucccagcua

SEQ ID NO: 1603 - RNA, 17 nt, Homo sapiens
uuacuauucccagcuac

SEQ ID NO: 1604 - RNA, 17 nt, Homo sapiens
ucccagcuacaugauca

SEQ ID NO: 1605 - RNA, 17 nt, Homo sapiens
uacaugaucagcuaugc

SEQ ID NO: 1606 - RNA, 17 nt, Homo sapiens
gaucagcuaugcuggca

SEQ ID NO: 1607 - RNA, 17 nt, Homo sapiens
ggcauggucuucuguga

SEQ ID NO: 1608 - RNA, 17 nt, Homo sapiens
cauggucuucugugaag

SEQ ID NO: 1609 - RNA, 17 nt, Homo sapiens
auggucuucugugaagc

SEQ ID NO: 1610 - RNA, 17 nt, Homo sapiens
gcaaaaauuaaugauga

SEQ ID NO: 1611 - RNA, 17 nt, Homo sapiens
caaaaauuaaugaugaa

SEQ ID NO: 1612 - RNA, 17 nt, Homo sapiens
augaaaguuaccagucu

SEQ ID NO: 1613 - RNA, 17 nt, Homo sapiens
ugaaaguuaccagucua

SEQ ID NO: 1614 - RNA, 17 nt, Homo sapiens
uuaccagucuauuaugu

SEQ ID NO: 1615 - RNA, 17 nt, Homo sapiens
accagucuauuauguac

SEQ ID NO: 1616 - RNA, 17 nt, Homo sapiens
cagucuauuauguacau

SEQ ID NO: 1617 - RNA, 17 nt, Homo sapiens
agucuauuauguacaua

SEQ ID NO: 1618 - RNA, 17 nt, Homo sapiens
uauuauguacauaguug

SEQ ID NO: 1619 - RNA, 17 nt, Homo sapiens
auguacauaguugucgu

SEQ ID NO: 1620 - RNA, 17 nt, Homo sapiens
uacauaguugucguugu

SEQ ID NO: 1621 - RNA, 17 nt, Homo sapiens
auaguugucguuguagg

SEQ ID NO: 1622 - RNA, 17 nt, Homo sapiens
guugucguuguagggua

SEQ ID NO: 1623 - RNA, 17 nt, Homo sapiens
gucguuguaggguauag

SEQ ID NO: 1624 - RNA, 17 nt, Homo sapiens
uguaggguauaggauuu

SEQ ID NO: 1625 - RNA, 17 nt, Homo sapiens
uaggguauaggauuuau

SEQ ID NO: 1626 - RNA, 17 nt, Homo sapiens
uauaggauuuaugaugu

SEQ ID NO: 1627 - RNA, 17 nt, Homo sapiens
auaggauuuaugaugug

SEQ ID NO: 1628 - RNA, 17 nt, Homo sapiens
uaggauuuaugaugugg

SEQ ID NO: 1629 - RNA, 17 nt, Homo sapiens
gaugugguucugagucc

SEQ ID NO: 1630 - RNA, 17 nt, Homo sapiens
augugguucugaguccg

SEQ ID NO: 1631 - RNA, 17 nt, Homo sapiens
uucugaguccgucucau

SEQ ID NO: 1632 - RNA, 17 nt, Homo sapiens
gaguccgucucauggaa

SEQ ID NO: 1633 - RNA, 17 nt, Homo sapiens
guccgucucauggaauu

SEQ ID NO: 1634 - RNA, 17 nt, Homo sapiens
cauggaauugaacuauc

SEQ ID NO: 1635 - RNA, 17 nt, Homo sapiens
auugaacuaucuguugg

SEQ ID NO: 1636 - RNA, 17 nt, Homo sapiens
ugaacuaucuguuggag

SEQ ID NO: 1637 - RNA, 17 nt, Homo sapiens
cuaucuguuggagaaaa

SEQ ID NO: 1638 - RNA, 17 nt, Homo sapiens
gaaaagcuugucuuaaa

SEQ ID NO: 1639 - RNA, 17 nt, Homo sapiens
aagcuugucuuaaauug

SEQ ID NO: 1640 - RNA, 17 nt, Homo sapiens
gcuugucuuaaauugua

SEQ ID NO: 1641 - RNA, 17 nt, Homo sapiens
cuugucuuaaauuguac

SEQ ID NO: 1642 - RNA, 17 nt, Homo sapiens
ucuuaaauuguacagca

SEQ ID NO: 1643 - RNA, 17 nt, Homo sapiens
uaaauuguacagcaaga

SEQ ID NO: 1644 - RNA, 17 nt, Homo sapiens
acugaacuaaauguggg

SEQ ID NO: 1645 - RNA, 17 nt, Homo sapiens
guggggauugacuucaa

SEQ ID NO: 1646 - RNA, 17 nt, Homo sapiens
gauugacuucaacuggg

SEQ ID NO: 1647 - RNA, 17 nt, Homo sapiens
auugacuucaacuggga

SEQ ID NO: 1648 - RNA, 17 nt, Homo sapiens
cugggaauacccuucuu

SEQ ID NO: 1649 - RNA, 17 nt, Homo sapiens
aauacccuucuucgaag

SEQ ID NO: 1650 - RNA, 17 nt, Homo sapiens
auacccuucuucgaagc

SEQ ID NO: 1651 - RNA, 17 nt, Homo sapiens
acccuucuucgaagcau

SEQ ID NO: 1652 - RNA, 17 nt, Homo sapiens
cccuucuucgaagcauc

SEQ ID NO: 1653 - RNA, 17 nt, Homo sapiens
cgaagcaucagcauaag

SEQ ID NO: 1654 - RNA, 17 nt, Homo sapiens
aucagcauaagaaacuu

SEQ ID NO: 1655 - RNA, 17 nt, Homo sapiens
aagaaacuuguaaaccg

SEQ ID NO: 1656 - RNA, 17 nt, Homo sapiens
aaacuuguaaaccgaga

SEQ ID NO: 1657 - RNA, 17 nt, Homo sapiens
cgagaccuaaaaaccca

SEQ ID NO: 1658 - RNA, 17 nt, Homo sapiens
aacccagucugggagug

SEQ ID NO: 1659 - RNA, 17 nt, Homo sapiens
gaagaaauuuuugagca

SEQ ID NO: 1660 - RNA, 17 nt, Homo sapiens
aagaaauuuuugagcac

SEQ ID NO: 1661 - RNA, 17 nt, Homo sapiens
agaaauuuuugagcacc

SEQ ID NO: 1662 - RNA, 17 nt, Homo sapiens
gaaauuuuugagcaccu

SEQ ID NO: 1663 - RNA, 17 nt, Homo sapiens
gagcaccuuaacuauag

SEQ ID NO: 1664 - RNA, 17 nt, Homo sapiens
agcaccuuaacuauaga

SEQ ID NO: 1665 - RNA, 17 nt, Homo sapiens
ccuuaacuauagauggu

SEQ ID NO: 1666 - RNA, 17 nt, Homo sapiens
uuaacuauagauggugu

SEQ ID NO: 1667 - RNA, 17 nt, Homo sapiens
gaugguguaacccggag

SEQ ID NO: 1668 - RNA, 17 nt, Homo sapiens
ccaaggauuguacaccu

SEQ ID NO: 1669 - RNA, 17 nt, Homo sapiens
aggauuguacaccugug

SEQ ID NO: 1670 - RNA, 17 nt, Homo sapiens
ugcagcauccagugggc

SEQ ID NO: 1671 - RNA, 17 nt, Homo sapiens
cagcacauuugucaggg

SEQ ID NO: 1672 - RNA, 17 nt, Homo sapiens
agcacauuugucagggu

SEQ ID NO: 1673 - RNA, 17 nt, Homo sapiens
acauuugucagggucca

SEQ ID NO: 1674 - RNA, 17 nt, Homo sapiens
gucaggguccaugaaaa

SEQ ID NO: 1675 - RNA, 17 nt, Homo sapiens
aaaaaccuuuuguugcu

SEQ ID NO: 1676 - RNA, 17 nt, Homo sapiens
aaaaccuuuuguugcuu

SEQ ID NO: 1677 - RNA, 17 nt, Homo sapiens
aaaccuuuuguugcuuu

SEQ ID NO: 1678 - RNA, 17 nt, Homo sapiens
ccuuuuguugcuuuugg

SEQ ID NO: 1679 - RNA, 17 nt, Homo sapiens
uuguugcuuuuggaagu

SEQ ID NO: 1680 - RNA, 17 nt, Homo sapiens
uguugcuuuuggaagug

SEQ ID NO: 1681 - RNA, 17 nt, Homo sapiens
guugcuuuuggaagugg

SEQ ID NO: 1682 - RNA, 17 nt, Homo sapiens
cauggaaucucuggugg

SEQ ID NO: 1683 - RNA, 17 nt, Homo sapiens
uggaaucucugguggaa

SEQ ID NO: 1684 - RNA, 17 nt, Homo sapiens
gagcgugucagaauccc

SEQ ID NO: 1685 - RNA, 17 nt, Homo sapiens
gucagaaucccugcgaa

SEQ ID NO: 1686 - RNA, 17 nt, Homo sapiens
ugcgaaguaccuugguu

SEQ ID NO: 1687 - RNA, 17 nt, Homo sapiens
aaguaccuugguuaccc

SEQ ID NO: 1688 - RNA, 17 nt, Homo sapiens
accuugguuacccaccc

SEQ ID NO: 1689 - RNA, 17 nt, Homo sapiens
ccuugguuacccacccc

SEQ ID NO: 1690 - RNA, 17 nt, Homo sapiens
ccagaaauaaaauggua

SEQ ID NO: 1691 - RNA, 17 nt, Homo sapiens
aaaaugguauaaaaaug

SEQ ID NO: 1692 - RNA, 17 nt, Homo sapiens
aaugguauaaaaaugga

SEQ ID NO: 1693 - RNA, 17 nt, Homo sapiens
aauggaauaccccuuga

SEQ ID NO: 1694 - RNA, 17 nt, Homo sapiens
auaccccuugaguccaa

SEQ ID NO: 1695 - RNA, 17 nt, Homo sapiens
ccuugaguccaaucaca

SEQ ID NO: 1696 - RNA, 17 nt, Homo sapiens
aguccaaucacacaauu

SEQ ID NO: 1697 - RNA, 17 nt, Homo sapiens
cacacaauuaaagcggg

SEQ ID NO: 1698 - RNA, 17 nt, Homo sapiens
acacaauuaaagcgggg

SEQ ID NO: 1699 - RNA, 17 nt, Homo sapiens
gggcauguacugacgau

SEQ ID NO: 1700 - RNA, 17 nt, Homo sapiens
cugacgauuauggaagu

SEQ ID NO: 1701 - RNA, 17 nt, Homo sapiens
ugacgauuauggaagug

SEQ ID NO: 1702 - RNA, 17 nt, Homo sapiens
caggaaauuacacuguc

SEQ ID NO: 1703 - RNA, 17 nt, Homo sapiens
aggaaauuacacuguca

SEQ ID NO: 1704 - RNA, 17 nt, Homo sapiens
uacacugucauccuuac

SEQ ID NO: 1705 - RNA, 17 nt, Homo sapiens
acugucauccuuaccaa

SEQ ID NO: 1706 - RNA, 17 nt, Homo sapiens
gucauccuuaccaaucc

SEQ ID NO: 1707 - RNA, 17 nt, Homo sapiens
ucauccuuaccaauccc

SEQ ID NO: 1708 - RNA, 17 nt, Homo sapiens
uuaccaaucccauuuca

SEQ ID NO: 1709 - RNA, 17 nt, Homo sapiens
aaucccauuucaaagga

SEQ ID NO: 1710 - RNA, 17 nt, Homo sapiens
aucccauuucaaaggag

SEQ ID NO: 1711 - RNA, 17 nt, Homo sapiens
ucccauuucaaaggaga

SEQ ID NO: 1712 - RNA, 17 nt, Homo sapiens
cauguggucucucuggu

SEQ ID NO: 1713 - RNA, 17 nt, Homo sapiens
uguggucucucugguug

SEQ ID NO: 1714 - RNA, 17 nt, Homo sapiens
uggucucucugguugug

SEQ ID NO: 1715 - RNA, 17 nt, Homo sapiens
ucucugguuguguaugu

SEQ ID NO: 1716 - RNA, 17 nt, Homo sapiens
gguuguguaugucccac

SEQ ID NO: 1717 - RNA, 17 nt, Homo sapiens
guguaugucccacccca

SEQ ID NO: 1718 - RNA, 17 nt, Homo sapiens
ccccagauuggugagaa

SEQ ID NO: 1719 - RNA, 17 nt, Homo sapiens
ugagaaaucucuaaucu

SEQ ID NO: 1720 - RNA, 17 nt, Homo sapiens
agaaaucucuaaucucu

SEQ ID NO: 1721 - RNA, 17 nt, Homo sapiens
aaaucucuaaucucucc

SEQ ID NO: 1722 - RNA, 17 nt, Homo sapiens
ucucuaaucucuccugu

SEQ ID NO: 1723 - RNA, 17 nt, Homo sapiens
ucuaaucucuccugugg

SEQ ID NO: 1724 - RNA, 17 nt, Homo sapiens
uaaucucuccuguggau

SEQ ID NO: 1725 - RNA, 17 nt, Homo sapiens
cuguggauuccuaccag

SEQ ID NO: 1726 - RNA, 17 nt, Homo sapiens
uguggauuccuaccagu

SEQ ID NO: 1727 - RNA, 17 nt, Homo sapiens
ggauuccuaccaguacg

SEQ ID NO: 1728 - RNA, 17 nt, Homo sapiens
cuaccaguacggcacca

SEQ ID NO: 1729 - RNA, 17 nt, Homo sapiens
gcaccacucaaacgcug

SEQ ID NO: 1730 - RNA, 17 nt, Homo sapiens
ugacauguacggucuau

SEQ ID NO: 1731 - RNA, 17 nt, Homo sapiens
uguacggucuaugccau

SEQ ID NO: 1732 - RNA, 17 nt, Homo sapiens
uacggucuaugccauuc

SEQ ID NO: 1733 - RNA, 17 nt, Homo sapiens
uaugccauuccuccccc

SEQ ID NO: 1734 - RNA, 17 nt, Homo sapiens
augccauuccucccccg

SEQ ID NO: 1735 - RNA, 17 nt, Homo sapiens
ccauuccucccccgcau

SEQ ID NO: 1736 - RNA, 17 nt, Homo sapiens
ccccgcaucacauccac

SEQ ID NO: 1737 - RNA, 17 nt, Homo sapiens
caucacauccacuggua

SEQ ID NO: 1738 - RNA, 17 nt, Homo sapiens
ccacugguauuggcagu

SEQ ID NO: 1739 - RNA, 17 nt, Homo sapiens
acugguauuggcaguug

SEQ ID NO: 1740 - RNA, 17 nt, Homo sapiens
uuggcaguuggaggaag

SEQ ID NO: 1741 - RNA, 17 nt, Homo sapiens
caagcugucucagugac

SEQ ID NO: 1742 - RNA, 17 nt, Homo sapiens
agcugucucagugacaa

SEQ ID NO: 1743 - RNA, 17 nt, Homo sapiens
aaacccauacccuugug

SEQ ID NO: 1744 - RNA, 17 nt, Homo sapiens
cauacccuugugaagaa

SEQ ID NO: 1745 - RNA, 17 nt, Homo sapiens
ggaggacuuccagggag

SEQ ID NO: 1746 - RNA, 17 nt, Homo sapiens
gaggacuuccagggagg

SEQ ID NO: 1747 - RNA, 17 nt, Homo sapiens
gaggaaauaaaauugaa

SEQ ID NO: 1748 - RNA, 17 nt, Homo sapiens
aauaaaauugaaguuaa

SEQ ID NO: 1749 - RNA, 17 nt, Homo sapiens
auugaaguuaauaaaaa

SEQ ID NO: 1750 - RNA, 17 nt, Homo sapiens
uugaaguuaauaaaaau

SEQ ID NO: 1751 - RNA, 17 nt, Homo sapiens
aaguuaauaaaaaucaa

SEQ ID NO: 1752 - RNA, 17 nt, Homo sapiens
auaaaaaucaauuugcu

SEQ ID NO: 1753 - RNA, 17 nt, Homo sapiens
aaaucaauuugcucuaa

SEQ ID NO: 1754 - RNA, 17 nt, Homo sapiens
aaucaauuugcucuaau

SEQ ID NO: 1755 - RNA, 17 nt, Homo sapiens
aauuugcucuaauugaa

SEQ ID NO: 1756 - RNA, 17 nt, Homo sapiens
uuugcucuaauugaagg

SEQ ID NO: 1757 - RNA, 17 nt, Homo sapiens
gcucuaauugaaggaaa

SEQ ID NO: 1758 - RNA, 17 nt, Homo sapiens
aaaacuguaaguacccu

SEQ ID NO: 1759 - RNA, 17 nt, Homo sapiens
cuguaaguacccuuguu

SEQ ID NO: 1760 - RNA, 17 nt, Homo sapiens
aguacccuuguuaucca

SEQ ID NO: 1761 - RNA, 17 nt, Homo sapiens
acccuuguuauccaagc

SEQ ID NO: 1762 - RNA, 17 nt, Homo sapiens
cccuuguuauccaagcg

SEQ ID NO: 1763 - RNA, 17 nt, Homo sapiens
cuuguuauccaagcggc

SEQ ID NO: 1764 - RNA, 17 nt, Homo sapiens
aaaugugucagcuuugu

SEQ ID NO: 1765 - RNA, 17 nt, Homo sapiens
ugucagcuuuguacaaa

SEQ ID NO: 1766 - RNA, 17 nt, Homo sapiens
gucagcuuuguacaaau

SEQ ID NO: 1767 - RNA, 17 nt, Homo sapiens
agcuuuguacaaaugug

SEQ ID NO: 1768 - RNA, 17 nt, Homo sapiens
gaagcggucaacaaagu

SEQ ID NO: 1769 - RNA, 17 nt, Homo sapiens
aacaaagucgggagagg

SEQ ID NO: 1770 - RNA, 17 nt, Homo sapiens
agggugaucuccuucca

SEQ ID NO: 1771 - RNA, 17 nt, Homo sapiens
ggugaucuccuuccacg

SEQ ID NO: 1772 - RNA, 17 nt, Homo sapiens
gaucuccuuccacguga

SEQ ID NO: 1773 - RNA, 17 nt, Homo sapiens
aucuccuuccacgugac

SEQ ID NO: 1774 - RNA, 17 nt, Homo sapiens
ccagggguccugaaauu

SEQ ID NO: 1775 - RNA, 17 nt, Homo sapiens
ccugaaauuacuuugca

SEQ ID NO: 1776 - RNA, 17 nt, Homo sapiens
cugaaauuacuuugcaa

SEQ ID NO: 1777 - RNA, 17 nt, Homo sapiens
aaauuacuuugcaaccu

SEQ ID NO: 1778 - RNA, 17 nt, Homo sapiens
aauuacuuugcaaccug

SEQ ID NO: 1779 - RNA, 17 nt, Homo sapiens
gagcgugucuuuguggu

SEQ ID NO: 1780 - RNA, 17 nt, Homo sapiens
gcgugucuuuguggugc

SEQ ID NO: 1781 - RNA, 17 nt, Homo sapiens
cgugucuuuguggugca

SEQ ID NO: 1782 - RNA, 17 nt, Homo sapiens
agacagaucuacguuug

SEQ ID NO: 1783 - RNA, 17 nt, Homo sapiens
acagaucuacguuugag

SEQ ID NO: 1784 - RNA, 17 nt, Homo sapiens
aucuacguuugagaacc

SEQ ID NO: 1785 - RNA, 17 nt, Homo sapiens
ucuacguuugagaaccu

SEQ ID NO: 1786 - RNA, 17 nt, Homo sapiens
gagaaccucacauggua

SEQ ID NO: 1787 - RNA, 17 nt, Homo sapiens
cacaugguacaagcuug

SEQ ID NO: 1788 - RNA, 17 nt, Homo sapiens
uacaagcuuggcccaca

SEQ ID NO: 1789 - RNA, 17 nt, Homo sapiens
cacagccucugccaauc

SEQ ID NO: 1790 - RNA, 17 nt, Homo sapiens
cugccaauccauguggg

SEQ ID NO: 1791 - RNA, 17 nt, Homo sapiens
gggagaguugcccacac

SEQ ID NO: 1792 - RNA, 17 nt, Homo sapiens
acaccuguuugcaagaa

SEQ ID NO: 1793 - RNA, 17 nt, Homo sapiens
caccuguuugcaagaac

SEQ ID NO: 1794 - RNA, 17 nt, Homo sapiens
caagaacuuggauacuc

SEQ ID NO: 1795 - RNA, 17 nt, Homo sapiens
acuuggauacucuuugg

SEQ ID NO: 1796 - RNA, 17 nt, Homo sapiens
uggauacucuuuggaaa

SEQ ID NO: 1797 - RNA, 17 nt, Homo sapiens
gauacucuuuggaaauu

SEQ ID NO: 1798 - RNA, 17 nt, Homo sapiens
auacucuuuggaaauug

SEQ ID NO: 1799 - RNA, 17 nt, Homo sapiens
uuggaaauugaaugcca

SEQ ID NO: 1800 - RNA, 17 nt, Homo sapiens
caccauguucucuaaua

SEQ ID NO: 1801 - RNA, 17 nt, Homo sapiens
accauguucucuaauag

SEQ ID NO: 1802 - RNA, 17 nt, Homo sapiens
cauguucucuaauagca

SEQ ID NO: 1803 - RNA, 17 nt, Homo sapiens
uguucucuaauagcaca

SEQ ID NO: 1804 - RNA, 17 nt, Homo sapiens
ucucuaauagcacaaau

SEQ ID NO: 1805 - RNA, 17 nt, Homo sapiens
aaugacauuuugaucau

SEQ ID NO: 1806 - RNA, 17 nt, Homo sapiens
augacauuuugaucaug

SEQ ID NO: 1807 - RNA, 17 nt, Homo sapiens
ugacauuuugaucaugg

SEQ ID NO: 1808 - RNA, 17 nt, Homo sapiens
auuuugaucauggagcu

SEQ ID NO: 1809 - RNA, 17 nt, Homo sapiens
auggagcuuaagaaugc

SEQ ID NO: 1810 - RNA, 17 nt, Homo sapiens
uggagcuuaagaaugca

SEQ ID NO: 1811 - RNA, 17 nt, Homo sapiens
gaaugcauccuugcagg

SEQ ID NO: 1812 - RNA, 17 nt, Homo sapiens
ugcauccuugcaggacc

SEQ ID NO: 1813 - RNA, 17 nt, Homo sapiens
aggagacuaugucugcc

SEQ ID NO: 1814 - RNA, 17 nt, Homo sapiens
gacuaugucugccuugc

SEQ ID NO: 1815 - RNA, 17 nt, Homo sapiens
gucugccuugcucaaga

SEQ ID NO: 1816 - RNA, 17 nt, Homo sapiens
gccuugcucaagacagg

SEQ ID NO: 1817 - RNA, 17 nt, Homo sapiens
aaagacauugcgugguc

SEQ ID NO: 1818 - RNA, 17 nt, Homo sapiens
ugcguggucaggcagcu

SEQ ID NO: 1819 - RNA, 17 nt, Homo sapiens
aggcagcucacaguccu

SEQ ID NO: 1820 - RNA, 17 nt, Homo sapiens
cucacaguccuagagcg

SEQ ID NO: 1821 - RNA, 17 nt, Homo sapiens
acaguccuagagcgugu

SEQ ID NO: 1822 - RNA, 17 nt, Homo sapiens
cccacgaucacaggaaa

SEQ ID NO: 1823 - RNA, 17 nt, Homo sapiens
uggagaaucagacgaca

SEQ ID NO: 1824 - RNA, 17 nt, Homo sapiens
cgacaaguauuggggaa

SEQ ID NO: 1825 - RNA, 17 nt, Homo sapiens
acaaguauuggggaaag

SEQ ID NO: 1826 - RNA, 17 nt, Homo sapiens
gaaagcaucgaagucuc

SEQ ID NO: 1827 - RNA, 17 nt, Homo sapiens
aucgaagucucaugcac

SEQ ID NO: 1828 - RNA, 17 nt, Homo sapiens
cgaagucucaugcacgg

SEQ ID NO: 1829 - RNA, 17 nt, Homo sapiens
cacggcaucugggaauc

SEQ ID NO: 1830 - RNA, 17 nt, Homo sapiens
cugggaaucccccucca

SEQ ID NO: 1831 - RNA, 17 nt, Homo sapiens
aucccccuccacagauc

SEQ ID NO: 1832 - RNA, 17 nt, Homo sapiens
ccacagaucaugugguu

SEQ ID NO: 1833 - RNA, 17 nt, Homo sapiens
caugugguuuaaagaua

SEQ ID NO: 1834 - RNA, 17 nt, Homo sapiens
augugguuuaaagauaa

SEQ ID NO: 1835 - RNA, 17 nt, Homo sapiens
ugugguuuaaagauaau

SEQ ID NO: 1836 - RNA, 17 nt, Homo sapiens
uuaaagauaaugagacc

SEQ ID NO: 1837 - RNA, 17 nt, Homo sapiens
gagacccuuguagaaga

SEQ ID NO: 1838 - RNA, 17 nt, Homo sapiens
acccuuguagaagacuc

SEQ ID NO: 1839 - RNA, 17 nt, Homo sapiens
agaagacucaggcauug

SEQ ID NO: 1840 - RNA, 17 nt, Homo sapiens
ucaggcauuguauugaa

SEQ ID NO: 1841 - RNA, 17 nt, Homo sapiens
ggcauuguauugaagga

SEQ ID NO: 1842 - RNA, 17 nt, Homo sapiens
cauuguauugaaggaug

SEQ ID NO: 1843 - RNA, 17 nt, Homo sapiens
cggaaccucacuauccg

SEQ ID NO: 1844 - RNA, 17 nt, Homo sapiens
accucacuauccgcaga

SEQ ID NO: 1845 - RNA, 17 nt, Homo sapiens
cucacuauccgcagagu

SEQ ID NO: 1846 - RNA, 17 nt, Homo sapiens
gaaggccucuacaccug

SEQ ID NO: 1847 - RNA, 17 nt, Homo sapiens
aggccucuacaccugcc

SEQ ID NO: 1848 - RNA, 17 nt, Homo sapiens
ugcaguguucuuggcug

SEQ ID NO: 1849 - RNA, 17 nt, Homo sapiens
gcaguguucuuggcugu

SEQ ID NO: 1850 - RNA, 17 nt, Homo sapiens
aguguucuuggcugugc

SEQ ID NO: 1851 - RNA, 17 nt, Homo sapiens
ggaggcauuuuucauaa

SEQ ID NO: 1852 - RNA, 17 nt, Homo sapiens
gaggcauuuuucauaau

SEQ ID NO: 1853 - RNA, 17 nt, Homo sapiens
aggcauuuuucauaaua

SEQ ID NO: 1854 - RNA, 17 nt, Homo sapiens
ggcauuuuucauaauag

SEQ ID NO: 1855 - RNA, 17 nt, Homo sapiens
gcauuuuucauaauaga

SEQ ID NO: 1856 - RNA, 17 nt, Homo sapiens
uuuuucauaauagaagg

SEQ ID NO: 1857 - RNA, 17 nt, Homo sapiens
uucauaauagaaggugc

SEQ ID NO: 1858 - RNA, 17 nt, Homo sapiens
gacgaacuuggaaauca

SEQ ID NO: 1859 - RNA, 17 nt, Homo sapiens
uuggaaaucauuauucu

SEQ ID NO: 1860 - RNA, 17 nt, Homo sapiens
gaaaucauuauucuagu

SEQ ID NO: 1861 - RNA, 17 nt, Homo sapiens
aaaucauuauucuagua

SEQ ID NO: 1862 - RNA, 17 nt, Homo sapiens
aucauuauucuaguagg

SEQ ID NO: 1863 - RNA, 17 nt, Homo sapiens
ucauuauucuaguaggc

SEQ ID NO: 1864 - RNA, 17 nt, Homo sapiens
auuauucuaguaggcac

SEQ ID NO: 1865 - RNA, 17 nt, Homo sapiens
auucuaguaggcacgac

SEQ ID NO: 1866 - RNA, 17 nt, Homo sapiens
acggugauugccauguu

SEQ ID NO: 1867 - RNA, 17 nt, Homo sapiens
ugccauguucuucuggc

SEQ ID NO: 1868 - RNA, 17 nt, Homo sapiens
gccauguucuucuggcu

SEQ ID NO: 1869 - RNA, 17 nt, Homo sapiens
cauguucuucuggcuac

SEQ ID NO: 1870 - RNA, 17 nt, Homo sapiens
auguucuucuggcuacu

SEQ ID NO: 1871 - RNA, 17 nt, Homo sapiens
uucuggcuacuucuugu

SEQ ID NO: 1872 - RNA, 17 nt, Homo sapiens
uggcuacuucuugucau

SEQ ID NO: 1873 - RNA, 17 nt, Homo sapiens
ggcuacuucuugucauc

SEQ ID NO: 1874 - RNA, 17 nt, Homo sapiens
cuacuucuugucaucau

SEQ ID NO: 1875 - RNA, 17 nt, Homo sapiens
cuucuugucaucauccu

SEQ ID NO: 1876 - RNA, 17 nt, Homo sapiens
cuugucaucauccuagg

SEQ ID NO: 1877 - RNA, 17 nt, Homo sapiens
gucaucauccuagggac

SEQ ID NO: 1878 - RNA, 17 nt, Homo sapiens
aucauccuagggaccgu

SEQ ID NO: 1879 - RNA, 17 nt, Homo sapiens
gggaccguuaagcgggc

SEQ ID NO: 1880 - RNA, 17 nt, Homo sapiens
ggaccguuaagcgggcc

SEQ ID NO: 1881 - RNA, 17 nt, Homo sapiens
gacaggcuacuugucca

SEQ ID NO: 1882 - RNA, 17 nt, Homo sapiens
aggcuacuuguccaucg

SEQ ID NO: 1883 - RNA, 17 nt, Homo sapiens
cuacuuguccaucguca

SEQ ID NO: 1884 - RNA, 17 nt, Homo sapiens
uuguccaucgucaugga

SEQ ID NO: 1885 - RNA, 17 nt, Homo sapiens
uccaucgucauggaucc

SEQ ID NO: 1886 - RNA, 17 nt, Homo sapiens
ucauggauccagaugaa

SEQ ID NO: 1887 - RNA, 17 nt, Homo sapiens
gaugaacucccauugga

SEQ ID NO: 1888 - RNA, 17 nt, Homo sapiens
acucccauuggaugaac

SEQ ID NO: 1889 - RNA, 17 nt, Homo sapiens
augaacauugugaacga

SEQ ID NO: 1890 - RNA, 17 nt, Homo sapiens
gacugccuuaugaugcc

SEQ ID NO: 1891 - RNA, 17 nt, Homo sapiens
acugccuuaugaugcca

SEQ ID NO: 1892 - RNA, 17 nt, Homo sapiens
augggaauuccccagag

SEQ ID NO: 1893 - RNA, 17 nt, Homo sapiens
ugggaauuccccagaga

SEQ ID NO: 1894 - RNA, 17 nt, Homo sapiens
cugaaccuagguaagcc

SEQ ID NO: 1895 - RNA, 17 nt, Homo sapiens
accuagguaagccucuu

SEQ ID NO: 1896 - RNA, 17 nt, Homo sapiens
guaagccucuuggccgu

SEQ ID NO: 1897 - RNA, 17 nt, Homo sapiens
aagccucuuggccgugg

SEQ ID NO: 1898 - RNA, 17 nt, Homo sapiens
uggugccuuuggccaag

SEQ ID NO: 1899 - RNA, 17 nt, Homo sapiens
ggugccuuuggccaaga

SEQ ID NO: 1900 - RNA, 17 nt, Homo sapiens
caagagauugaagcaga

SEQ ID NO: 1901 - RNA, 17 nt, Homo sapiens
agaugccuuuggaauug

SEQ ID NO: 1902 - RNA, 17 nt, Homo sapiens
gaugccuuuggaauuga

SEQ ID NO: 1903 - RNA, 17 nt, Homo sapiens
uuuggaauugacaagac

SEQ ID NO: 1904 - RNA, 17 nt, Homo sapiens
cagcaacuugcaggaca

SEQ ID NO: 1905 - RNA, 17 nt, Homo sapiens
aggacaguagcagucaa

SEQ ID NO: 1906 - RNA, 17 nt, Homo sapiens
guagcagucaaaauguu

SEQ ID NO: 1907 - RNA, 17 nt, Homo sapiens
caaaauguugaaagaag

SEQ ID NO: 1908 - RNA, 17 nt, Homo sapiens
gugagcaucgagcucuc

SEQ ID NO: 1909 - RNA, 17 nt, Homo sapiens
aucgagcucucaugucu

SEQ ID NO: 1910 - RNA, 17 nt, Homo sapiens
cgagcucucaugucuga

SEQ ID NO: 1911 - RNA, 17 nt, Homo sapiens
ucucaugucugaacuca

SEQ ID NO: 1912 - RNA, 17 nt, Homo sapiens
ucugaacucaagauccu

SEQ ID NO: 1913 - RNA, 17 nt, Homo sapiens
cucaagauccucauuca

SEQ ID NO: 1914 - RNA, 17 nt, Homo sapiens
aagauccucauucauau

SEQ ID NO: 1915 - RNA, 17 nt, Homo sapiens
auccucauucauauugg

SEQ ID NO: 1916 - RNA, 17 nt, Homo sapiens
uccucauucauauuggu

SEQ ID NO: 1917 - RNA, 17 nt, Homo sapiens
ucauucauauuggucac

SEQ ID NO: 1918 - RNA, 17 nt, Homo sapiens
auucauauuggucacca

SEQ ID NO: 1919 - RNA, 17 nt, Homo sapiens
auauuggucaccaucuc

SEQ ID NO: 1920 - RNA, 17 nt, Homo sapiens
gucaccaucucaaugug

SEQ ID NO: 1921 - RNA, 17 nt, Homo sapiens
caccaucucaauguggu

SEQ ID NO: 1922 - RNA, 17 nt, Homo sapiens
aauguggucaaccuucu

SEQ ID NO: 1923 - RNA, 17 nt, Homo sapiens
gucaaccuucuaggugc

SEQ ID NO: 1924 - RNA, 17 nt, Homo sapiens
ucaaccuucuaggugcc

SEQ ID NO: 1925 - RNA, 17 nt, Homo sapiens
aaccuucuaggugccug

SEQ ID NO: 1926 - RNA, 17 nt, Homo sapiens
gugccuguaccaagcca

SEQ ID NO: 1927 - RNA, 17 nt, Homo sapiens
gggccacucauggugau

SEQ ID NO: 1928 - RNA, 17 nt, Homo sapiens
auggugauuguggaauu

SEQ ID NO: 1929 - RNA, 17 nt, Homo sapiens
uguggaauucugcaaau

SEQ ID NO: 1930 - RNA, 17 nt, Homo sapiens
guggaauucugcaaauu

SEQ ID NO: 1931 - RNA, 17 nt, Homo sapiens
cugcaaauuuggaaacc

SEQ ID NO: 1932 - RNA, 17 nt, Homo sapiens
ugcaaauuuggaaaccu

SEQ ID NO: 1933 - RNA, 17 nt, Homo sapiens
aaaccuguccacuuacc

SEQ ID NO: 1934 - RNA, 17 nt, Homo sapiens
uguccacuuaccugagg

SEQ ID NO: 1935 - RNA, 17 nt, Homo sapiens
guccacuuaccugagga

SEQ ID NO: 1936 - RNA, 17 nt, Homo sapiens
aaaugaauuuguccccu

SEQ ID NO: 1937 - RNA, 17 nt, Homo sapiens
aaugaauuuguccccua

SEQ ID NO: 1938 - RNA, 17 nt, Homo sapiens
gaauuuguccccuacaa

SEQ ID NO: 1939 - RNA, 17 nt, Homo sapiens
uguccccuacaagacca

SEQ ID NO: 1940 - RNA, 17 nt, Homo sapiens
ggcacgauuccgucaag

SEQ ID NO: 1941 - RNA, 17 nt, Homo sapiens
gcacgauuccgucaagg

SEQ ID NO: 1942 - RNA, 17 nt, Homo sapiens
gauuccgucaagggaaa

SEQ ID NO: 1943 - RNA, 17 nt, Homo sapiens
gaaagacuacguuggag

SEQ ID NO: 1944 - RNA, 17 nt, Homo sapiens
gacuacguuggagcaau

SEQ ID NO: 1945 - RNA, 17 nt, Homo sapiens
ggagcaaucccugugga

SEQ ID NO: 1946 - RNA, 17 nt, Homo sapiens
cuguggaucugaaacgg

SEQ ID NO: 1947 - RNA, 17 nt, Homo sapiens
acggcgcuuggacagca

SEQ ID NO: 1948 - RNA, 17 nt, Homo sapiens
gacagcaucaccaguag

SEQ ID NO: 1949 - RNA, 17 nt, Homo sapiens
ucaccaguagccagagc

SEQ ID NO: 1950 - RNA, 17 nt, Homo sapiens
ccagagcucagccagcu

SEQ ID NO: 1951 - RNA, 17 nt, Homo sapiens
agccagcucuggauuug

SEQ ID NO: 1952 - RNA, 17 nt, Homo sapiens
cucuggauuuguggagg

SEQ ID NO: 1953 - RNA, 17 nt, Homo sapiens
ucuggauuuguggagga

SEQ ID NO: 1954 - RNA, 17 nt, Homo sapiens
ggagaagucccucagug

SEQ ID NO: 1955 - RNA, 17 nt, Homo sapiens
aagucccucagugaugu

SEQ ID NO: 1956 - RNA, 17 nt, Homo sapiens
agugauguagaagaaga

SEQ ID NO: 1957 - RNA, 17 nt, Homo sapiens
aggaagcuccugaagau

SEQ ID NO: 1958 - RNA, 17 nt, Homo sapiens
cugaagaucuguauaag

SEQ ID NO: 1959 - RNA, 17 nt, Homo sapiens
agaucuguauaaggacu

SEQ ID NO: 1960 - RNA, 17 nt, Homo sapiens
aucuguauaaggacuuc

SEQ ID NO: 1961 - RNA, 17 nt, Homo sapiens
uaaggacuuccugaccu

SEQ ID NO: 1962 - RNA, 17 nt, Homo sapiens
aaggacuuccugaccuu

SEQ ID NO: 1963 - RNA, 17 nt, Homo sapiens
ccugaccuuggagcauc

SEQ ID NO: 1964 - RNA, 17 nt, Homo sapiens
uggagcaucucaucugu

SEQ ID NO: 1965 - RNA, 17 nt, Homo sapiens
gagcaucucaucuguua

SEQ ID NO: 1966 - RNA, 17 nt, Homo sapiens
caucucaucuguuacag

SEQ ID NO: 1967 - RNA, 17 nt, Homo sapiens
ucaucuguuacagcuuc

SEQ ID NO: 1968 - RNA, 17 nt, Homo sapiens
caucuguuacagcuucc

SEQ ID NO: 1969 - RNA, 17 nt, Homo sapiens
uuacagcuuccaagugg

SEQ ID NO: 1970 - RNA, 17 nt, Homo sapiens
uacagcuuccaaguggc

SEQ ID NO: 1971 - RNA, 17 nt, Homo sapiens
aaguggcuaagggcaug

SEQ ID NO: 1972 - RNA, 17 nt, Homo sapiens
cauggaguucuuggcau

SEQ ID NO: 1973 - RNA, 17 nt, Homo sapiens
auggaguucuuggcauc

SEQ ID NO: 1974 - RNA, 17 nt, Homo sapiens
ggaguucuuggcaucgc

SEQ ID NO: 1975 - RNA, 17 nt, Homo sapiens
cuuggcaucgcgaaagu

SEQ ID NO: 1976 - RNA, 17 nt, Homo sapiens
gaaaguguauccacagg

SEQ ID NO: 1977 - RNA, 17 nt, Homo sapiens
aaguguauccacaggga

SEQ ID NO: 1978 - RNA, 17 nt, Homo sapiens
cacgaaauauccucuua

SEQ ID NO: 1979 - RNA, 17 nt, Homo sapiens
cgaaauauccucuuauc

SEQ ID NO: 1980 - RNA, 17 nt, Homo sapiens
aauauccucuuaucgga

SEQ ID NO: 1981 - RNA, 17 nt, Homo sapiens
uauccucuuaucggaga

SEQ ID NO: 1982 - RNA, 17 nt, Homo sapiens
auccucuuaucggagaa

SEQ ID NO: 1983 - RNA, 17 nt, Homo sapiens
ccucuuaucggagaaga

SEQ ID NO: 1984 - RNA, 17 nt, Homo sapiens
aacgugguuaaaaucug

SEQ ID NO: 1985 - RNA, 17 nt, Homo sapiens
acgugguuaaaaucugu

SEQ ID NO: 1986 - RNA, 17 nt, Homo sapiens
guuaaaaucugugacuu

SEQ ID NO: 1987 - RNA, 17 nt, Homo sapiens
cugugacuuuggcuugg

SEQ ID NO: 1988 - RNA, 17 nt, Homo sapiens
ugugacuuuggcuuggc

SEQ ID NO: 1989 - RNA, 17 nt, Homo sapiens
cuuuggcuuggcccggg

SEQ ID NO: 1990 - RNA, 17 nt, Homo sapiens
cccgggauauuuauaaa

SEQ ID NO: 1991 - RNA, 17 nt, Homo sapiens
cgggauauuuauaaaga

SEQ ID NO: 1992 - RNA, 17 nt, Homo sapiens
gggauauuuauaaagau

SEQ ID NO: 1993 - RNA, 17 nt, Homo sapiens
ggauauuuauaaagauc

SEQ ID NO: 1994 - RNA, 17 nt, Homo sapiens
auauuuauaaagaucca

SEQ ID NO: 1995 - RNA, 17 nt, Homo sapiens
auaaagauccagauuau

SEQ ID NO: 1996 - RNA, 17 nt, Homo sapiens
auccagauuaugucaga

SEQ ID NO: 1997 - RNA, 17 nt, Homo sapiens
uccagauuaugucagaa

SEQ ID NO: 1998 - RNA, 17 nt, Homo sapiens
gauuaugucagaaaagg

SEQ ID NO: 1999 - RNA, 17 nt, Homo sapiens
gagaugcucgccucccu

SEQ ID NO: 2000 - RNA, 17 nt, Homo sapiens
gcucgccucccuuugaa

SEQ ID NO: 2001 - RNA, 17 nt, Homo sapiens
gccucccuuugaaaugg

SEQ ID NO: 2002 - RNA, 17 nt, Homo sapiens
ccucccuuugaaaugga

SEQ ID NO: 2003 - RNA, 17 nt, Homo sapiens
gaaacaauuuuugacag

SEQ ID NO: 2004 - RNA, 17 nt, Homo sapiens
aaacaauuuuugacaga

SEQ ID NO: 2005 - RNA, 17 nt, Homo sapiens
aacaauuuuugacagag

SEQ ID NO: 2006 - RNA, 17 nt, Homo sapiens
acaauuuuugacagagu

SEQ ID NO: 2007 - RNA, 17 nt, Homo sapiens
cagaguguacacaaucc

SEQ ID NO: 2008 - RNA, 17 nt, Homo sapiens
uacacaauccagaguga

SEQ ID NO: 2009 - RNA, 17 nt, Homo sapiens
agugacgucuggucuuu

SEQ ID NO: 2010 - RNA, 17 nt, Homo sapiens
cgucuggucuuuuggug

SEQ ID NO: 2011 - RNA, 17 nt, Homo sapiens
ucuggucuuuugguguu

SEQ ID NO: 2012 - RNA, 17 nt, Homo sapiens
cuggucuuuugguguuu

SEQ ID NO: 2013 - RNA, 17 nt, Homo sapiens
uggucuuuugguguuuu

SEQ ID NO: 2014 - RNA, 17 nt, Homo sapiens
uuugguguuuugcugug

SEQ ID NO: 2015 - RNA, 17 nt, Homo sapiens
uugguguuuugcugugg

SEQ ID NO: 2016 - RNA, 17 nt, Homo sapiens
ugguguuuugcuguggg

SEQ ID NO: 2017 - RNA, 17 nt, Homo sapiens
ugggaaauauuuuccuu

SEQ ID NO: 2018 - RNA, 17 nt, Homo sapiens
ggaaauauuuuccuuag

SEQ ID NO: 2019 - RNA, 17 nt, Homo sapiens
gaaauauuuuccuuagg

SEQ ID NO: 2020 - RNA, 17 nt, Homo sapiens
aaauauuuuccuuaggu

SEQ ID NO: 2021 - RNA, 17 nt, Homo sapiens
aauauuuuccuuaggug

SEQ ID NO: 2022 - RNA, 17 nt, Homo sapiens
auuuuccuuaggugcuu

SEQ ID NO: 2023 - RNA, 17 nt, Homo sapiens
uuuuccuuaggugcuuc

SEQ ID NO: 2024 - RNA, 17 nt, Homo sapiens
uaggugcuucuccauau

SEQ ID NO: 2025 - RNA, 17 nt, Homo sapiens
aggugcuucuccauauc

SEQ ID NO: 2026 - RNA, 17 nt, Homo sapiens
gugcuucuccauauccu

SEQ ID NO: 2027 - RNA, 17 nt, Homo sapiens
uucuccauauccugggg

SEQ ID NO: 2028 - RNA, 17 nt, Homo sapiens
cuccauauccuggggua

SEQ ID NO: 2029 - RNA, 17 nt, Homo sapiens
ccugggguaaagauuga

SEQ ID NO: 2030 - RNA, 17 nt, Homo sapiens
guaaagauugaugaaga

SEQ ID NO: 2031 - RNA, 17 nt, Homo sapiens
ugaagaauuuuguaggc

SEQ ID NO: 2032 - RNA, 17 nt, Homo sapiens
gaagaauuuuguaggcg

SEQ ID NO: 2033 - RNA, 17 nt, Homo sapiens
aagaauuuuguaggcga

SEQ ID NO: 2034 - RNA, 17 nt, Homo sapiens
aauuuuguaggcgauug

SEQ ID NO: 2035 - RNA, 17 nt, Homo sapiens
uaggcgauugaaagaag

SEQ ID NO: 2036 - RNA, 17 nt, Homo sapiens
aaggaacuagaaugagg

SEQ ID NO: 2037 - RNA, 17 nt, Homo sapiens
ccccugauuauacuaca

SEQ ID NO: 2038 - RNA, 17 nt, Homo sapiens
cccugauuauacuacac

SEQ ID NO: 2039 - RNA, 17 nt, Homo sapiens
cugauuauacuacacca

SEQ ID NO: 2040 - RNA, 17 nt, Homo sapiens
auuauacuacaccagaa

SEQ ID NO: 2041 - RNA, 17 nt, Homo sapiens
agaaauguaccagacca

SEQ ID NO: 2042 - RNA, 17 nt, Homo sapiens
agcccagucagagaccc

SEQ ID NO: 2043 - RNA, 17 nt, Homo sapiens
acccacguuuucagagu

SEQ ID NO: 2044 - RNA, 17 nt, Homo sapiens
cccacguuuucagaguu

SEQ ID NO: 2045 - RNA, 17 nt, Homo sapiens
ccacguuuucagaguug

SEQ ID NO: 2046 - RNA, 17 nt, Homo sapiens
cacguuuucagaguugg

SEQ ID NO: 2047 - RNA, 17 nt, Homo sapiens
uucagaguugguggaac

SEQ ID NO: 2048 - RNA, 17 nt, Homo sapiens
uggaacauuugggaaau

SEQ ID NO: 2049 - RNA, 17 nt, Homo sapiens
ggaacauuugggaaauc

SEQ ID NO: 2050 - RNA, 17 nt, Homo sapiens
ugggaaaucucuugcaa

SEQ ID NO: 2051 - RNA, 17 nt, Homo sapiens
ggaaaucucuugcaagc

SEQ ID NO: 2052 - RNA, 17 nt, Homo sapiens
aaaucucuugcaagcua

SEQ ID NO: 2053 - RNA, 17 nt, Homo sapiens
ugcaagcuaaugcucag

SEQ ID NO: 2054 - RNA, 17 nt, Homo sapiens
cuaaugcucagcaggau

SEQ ID NO: 2055 - RNA, 17 nt, Homo sapiens
caaagacuacauuguuc

SEQ ID NO: 2056 - RNA, 17 nt, Homo sapiens
gacuacauuguucuucc

SEQ ID NO: 2057 - RNA, 17 nt, Homo sapiens
uacauuguucuuccgau

SEQ ID NO: 2058 - RNA, 17 nt, Homo sapiens
acauuguucuuccgaua

SEQ ID NO: 2059 - RNA, 17 nt, Homo sapiens
auuguucuuccgauauc

SEQ ID NO: 2060 - RNA, 17 nt, Homo sapiens
uuguucuuccgauauca

SEQ ID NO: 2061 - RNA, 17 nt, Homo sapiens
cuuccgauaucagagac

SEQ ID NO: 2062 - RNA, 17 nt, Homo sapiens
uccgauaucagagacuu

SEQ ID NO: 2063 - RNA, 17 nt, Homo sapiens
cagagacuuugagcaug

SEQ ID NO: 2064 - RNA, 17 nt, Homo sapiens
agagacuuugagcaugg

SEQ ID NO: 2065 - RNA, 17 nt, Homo sapiens
aagaggauucuggacuc

SEQ ID NO: 2066 - RNA, 17 nt, Homo sapiens
agaggauucuggacucu

SEQ ID NO: 2067 - RNA, 17 nt, Homo sapiens
ucuggacucucucugcc

SEQ ID NO: 2068 - RNA, 17 nt, Homo sapiens
uggacucucucugccua

SEQ ID NO: 2069 - RNA, 17 nt, Homo sapiens
gacucucucugccuacc

SEQ ID NO: 2070 - RNA, 17 nt, Homo sapiens
cucugccuaccucaccu

SEQ ID NO: 2071 - RNA, 17 nt, Homo sapiens
gccuaccucaccuguuu

SEQ ID NO: 2072 - RNA, 17 nt, Homo sapiens
ucaccuguuuccuguau

SEQ ID NO: 2073 - RNA, 17 nt, Homo sapiens
caccuguuuccuguaug

SEQ ID NO: 2074 - RNA, 17 nt, Homo sapiens
accuguuuccuguaugg

SEQ ID NO: 2075 - RNA, 17 nt, Homo sapiens
uuuccuguauggaggag

SEQ ID NO: 2076 - RNA, 17 nt, Homo sapiens
gaggaaguaugugaccc

SEQ ID NO: 2077 - RNA, 17 nt, Homo sapiens
ccccaaauuccauuaug

SEQ ID NO: 2078 - RNA, 17 nt, Homo sapiens
cccaaauuccauuauga

SEQ ID NO: 2079 - RNA, 17 nt, Homo sapiens
aauuccauuaugacaac

SEQ ID NO: 2080 - RNA, 17 nt, Homo sapiens
auuccauuaugacaaca

SEQ ID NO: 2081 - RNA, 17 nt, Homo sapiens
gcaggaaucagucagua

SEQ ID NO: 2082 - RNA, 17 nt, Homo sapiens
gaaucagucaguaucug

SEQ ID NO: 2083 - RNA, 17 nt, Homo sapiens
cagucaguaucugcaga

SEQ ID NO: 2084 - RNA, 17 nt, Homo sapiens
gucaguaucugcagaac

SEQ ID NO: 2085 - RNA, 17 nt, Homo sapiens
agaacaguaagcgaaag

SEQ ID NO: 2086 - RNA, 17 nt, Homo sapiens
gugaguguaaaaacauu

SEQ ID NO: 2087 - RNA, 17 nt, Homo sapiens
aaaaacauuugaagaua

SEQ ID NO: 2088 - RNA, 17 nt, Homo sapiens
aaaacauuugaagauau

SEQ ID NO: 2089 - RNA, 17 nt, Homo sapiens
uugaagauaucccguua

SEQ ID NO: 2090 - RNA, 17 nt, Homo sapiens
gaagauaucccguuaga

SEQ ID NO: 2091 - RNA, 17 nt, Homo sapiens
uaucccguuagaagaac

SEQ ID NO: 2092 - RNA, 17 nt, Homo sapiens
aucccguuagaagaacc

SEQ ID NO: 2093 - RNA, 17 nt, Homo sapiens
ccagaaguaaaaguaau

SEQ ID NO: 2094 - RNA, 17 nt, Homo sapiens
guaaaaguaaucccaga

SEQ ID NO: 2095 - RNA, 17 nt, Homo sapiens
aaaguaaucccagauga

SEQ ID NO: 2096 - RNA, 17 nt, Homo sapiens
acagugguaugguucuu

SEQ ID NO: 2097 - RNA, 17 nt, Homo sapiens
gguaugguucuugccuc

SEQ ID NO: 2098 - RNA, 17 nt, Homo sapiens
guaugguucuugccuca

SEQ ID NO: 2099 - RNA, 17 nt, Homo sapiens
augguucuugccucaga

SEQ ID NO: 2100 - RNA, 17 nt, Homo sapiens
ucuugccucagaagagc

SEQ ID NO: 2101 - RNA, 17 nt, Homo sapiens
ugaaaacuuuggaagac

SEQ ID NO: 2102 - RNA, 17 nt, Homo sapiens
gaaaacuuuggaagaca

SEQ ID NO: 2103 - RNA, 17 nt, Homo sapiens
aaccaaauuaucuccau

SEQ ID NO: 2104 - RNA, 17 nt, Homo sapiens
accaaauuaucuccauc

SEQ ID NO: 2105 - RNA, 17 nt, Homo sapiens
caaauuaucuccaucuu

SEQ ID NO: 2106 - RNA, 17 nt, Homo sapiens
aauuaucuccaucuuuu

SEQ ID NO: 2107 - RNA, 17 nt, Homo sapiens
aucuccaucuuuuggug

SEQ ID NO: 2108 - RNA, 17 nt, Homo sapiens
cuccaucuuuuggugga

SEQ ID NO: 2109 - RNA, 17 nt, Homo sapiens
uccaucuuuugguggaa

SEQ ID NO: 2110 - RNA, 17 nt, Homo sapiens
ccaucuuuugguggaau

SEQ ID NO: 2111 - RNA, 17 nt, Homo sapiens
cagggagucuguggcau

SEQ ID NO: 2112 - RNA, 17 nt, Homo sapiens
uguggcaucugaaggcu

SEQ ID NO: 2113 - RNA, 17 nt, Homo sapiens
ugaaggcucaaaccaga

SEQ ID NO: 2114 - RNA, 17 nt, Homo sapiens
aagcggcuaccaguccg

SEQ ID NO: 2115 - RNA, 17 nt, Homo sapiens
cuaccaguccggauauc

SEQ ID NO: 2116 - RNA, 17 nt, Homo sapiens
guccggauaucacuccg

SEQ ID NO: 2117 - RNA, 17 nt, Homo sapiens
ccggauaucacuccgau

SEQ ID NO: 2118 - RNA, 17 nt, Homo sapiens
auaucacuccgaugaca

SEQ ID NO: 2119 - RNA, 17 nt, Homo sapiens
caccguguacuccagug

SEQ ID NO: 2120 - RNA, 17 nt, Homo sapiens
cguguacuccagugagg

SEQ ID NO: 2121 - RNA, 17 nt, Homo sapiens
gcagaacuuuuaaagcu

SEQ ID NO: 2122 - RNA, 17 nt, Homo sapiens
cagaacuuuuaaagcug

SEQ ID NO: 2123 - RNA, 17 nt, Homo sapiens
agaacuuuuaaagcuga

SEQ ID NO: 2124 - RNA, 17 nt, Homo sapiens
gaacuuuuaaagcugau

SEQ ID NO: 2125 - RNA, 17 nt, Homo sapiens
aagcugauagagauugg

SEQ ID NO: 2126 - RNA, 17 nt, Homo sapiens
auagagauuggagugca

SEQ ID NO: 2127 - RNA, 17 nt, Homo sapiens
aaaccgguagcacagcc

SEQ ID NO: 2128 - RNA, 17 nt, Homo sapiens
gcccagauucuccagcc

SEQ ID NO: 2129 - RNA, 17 nt, Homo sapiens
cccagauucuccagccu

SEQ ID NO: 2130 - RNA, 17 nt, Homo sapiens
cagauucuccagccuga

SEQ ID NO: 2131 - RNA, 17 nt, Homo sapiens
acugagcucuccuccug

SEQ ID NO: 2132 - RNA, 17 nt, Homo sapiens
ugagcucuccuccuguu

SEQ ID NO: 2133 - RNA, 17 nt, Homo sapiens
gcucuccuccuguuuaa

SEQ ID NO: 2134 - RNA, 17 nt, Homo sapiens
ccuccuguuuaaaagga

SEQ ID NO: 2135 - RNA, 17 nt, Homo sapiens
cuccuguuuaaaaggaa

SEQ ID NO: 2136 - RNA, 17 nt, Homo sapiens
uccuguuuaaaaggaag

SEQ ID NO: 2137 - RNA, 17 nt, Homo sapiens
ggaagcauccacacccc

SEQ ID NO: 2138 - RNA, 17 nt, Homo sapiens
ccccaacucccggacau

SEQ ID NO: 2139 - RNA, 17 nt, Homo sapiens
ccggacaucacaugaga

SEQ ID NO: 2140 - RNA, 17 nt, Homo sapiens
ugagaggucugcucaga

SEQ ID NO: 2141 - RNA, 17 nt, Homo sapiens
ggucugcucagauuuug

SEQ ID NO: 2142 - RNA, 17 nt, Homo sapiens
gcucagauuuugaagug

SEQ ID NO: 2143 - RNA, 17 nt, Homo sapiens
cucagauuuugaagugu

SEQ ID NO: 2144 - RNA, 17 nt, Homo sapiens
ucagauuuugaaguguu

SEQ ID NO: 2145 - RNA, 17 nt, Homo sapiens
ugaaguguuguucuuuc

SEQ ID NO: 2146 - RNA, 17 nt, Homo sapiens
aguguuguucuuuccac

SEQ ID NO: 2147 - RNA, 17 nt, Homo sapiens
guguuguucuuuccacc

SEQ ID NO: 2148 - RNA, 17 nt, Homo sapiens
guuguucuuuccaccag

SEQ ID NO: 2149 - RNA, 17 nt, Homo sapiens
uuguucuuuccaccagc

SEQ ID NO: 2150 - RNA, 17 nt, Homo sapiens
uguucuuuccaccagca

SEQ ID NO: 2151 - RNA, 17 nt, Homo sapiens
caggaaguagccgcauu

SEQ ID NO: 2152 - RNA, 17 nt, Homo sapiens
agccgcauuugauuuuc

SEQ ID NO: 2153 - RNA, 17 nt, Homo sapiens
gccgcauuugauuuuca

SEQ ID NO: 2154 - RNA, 17 nt, Homo sapiens
cauuugauuuucauuuc

SEQ ID NO: 2155 - RNA, 17 nt, Homo sapiens
auuugauuuucauuucg

SEQ ID NO: 2156 - RNA, 17 nt, Homo sapiens
uuugauuuucauuucga

SEQ ID NO: 2157 - RNA, 17 nt, Homo sapiens
uugauuuucauuucgac

SEQ ID NO: 2158 - RNA, 17 nt, Homo sapiens
auuuucauuucgacaac

SEQ ID NO: 2159 - RNA, 17 nt, Homo sapiens
uuuucauuucgacaaca

SEQ ID NO: 2160 - RNA, 17 nt, Homo sapiens
uuucauuucgacaacag

SEQ ID NO: 2161 - RNA, 17 nt, Homo sapiens
aaggaccucggacugca

SEQ ID NO: 2162 - RNA, 17 nt, Homo sapiens
agccagcucuucuaggc

SEQ ID NO: 2163 - RNA, 17 nt, Homo sapiens
ccagcucuucuaggcuu

SEQ ID NO: 2164 - RNA, 17 nt, Homo sapiens
cagcucuucuaggcuug

SEQ ID NO: 2165 - RNA, 17 nt, Homo sapiens
gcucuucuaggcuugug

SEQ ID NO: 2166 - RNA, 18 nt, Homo sapiens
aggugcugcuggccgucg

SEQ ID NO: 2167 - RNA, 18 nt, Homo sapiens
gcuggccgucgcccugug

SEQ ID NO: 2168 - RNA, 18 nt, Homo sapiens
ccgggccgccucuguggg

SEQ ID NO: 2169 - RNA, 18 nt, Homo sapiens
uugaucugcccaggcuca

SEQ ID NO: 2170 - RNA, 18 nt, Homo sapiens
ggaaacugacuuggccuc

SEQ ID NO: 2171 - RNA, 18 nt, Homo sapiens
gauuacagaucuccauuu

SEQ ID NO: 2172 - RNA, 18 nt, Homo sapiens
uguuccugaugguaacag

SEQ ID NO: 2173 - RNA, 18 nt, Homo sapiens
guuaccagucuauuaugu

SEQ ID NO: 2174 - RNA, 18 nt, Homo sapiens
ugaguccgucucauggaa

SEQ ID NO: 2175 - RNA, 18 nt, Homo sapiens
acuaucuguuggagaaaa

SEQ ID NO: 2176 - RNA, 18 nt, Homo sapiens
aaacccagucugggagug

SEQ ID NO: 2177 - RNA, 18 nt, Homo sapiens
gugggcugaugaccaaga

SEQ ID NO: 2178 - RNA, 18 nt, Homo sapiens
auguacugacgauuaugg

SEQ ID NO: 2179 - RNA, 18 nt, Homo sapiens
caccccagauuggugaga

SEQ ID NO: 2180 - RNA, 18 nt, Homo sapiens
auguacggucuaugccau

SEQ ID NO: 2181 - RNA, 18 nt, Homo sapiens
auuggcaguuggaggaag

SEQ ID NO: 2182 - RNA, 18 nt, Homo sapiens
ccaagcugucucagugac

SEQ ID NO: 2183 - RNA, 18 nt, Homo sapiens
ugugucagcuuuguacaa

SEQ ID NO: 2184 - RNA, 18 nt, Homo sapiens
acaugcagcccacugagc

SEQ ID NO: 2185 - RNA, 18 nt, Homo sapiens
gcagacagaucuacguuu

SEQ ID NO: 2186 - RNA, 18 nt, Homo sapiens
gcccacagccucugccaa

SEQ ID NO: 2187 - RNA, 18 nt, Homo sapiens
cacaccuguuugcaagaa

SEQ ID NO: 2188 - RNA, 18 nt, Homo sapiens
uaugucugccuugcucaa

SEQ ID NO: 2189 - RNA, 18 nt, Homo sapiens
ucaggcagcucacagucc

SEQ ID NO: 2190 - RNA, 18 nt, Homo sapiens
gcucacaguccuagagcg

SEQ ID NO: 2191 - RNA, 18 nt, Homo sapiens
agaaucagacgacaagua

SEQ ID NO: 2192 - RNA, 18 nt, Homo sapiens
cuccacagaucauguggu

SEQ ID NO: 2193 - RNA, 18 nt, Homo sapiens
ggauccagaugaacuccc

SEQ ID NO: 2194 - RNA, 18 nt, Homo sapiens
aacgacugccuuaugaug

SEQ ID NO: 2195 - RNA, 18 nt, Homo sapiens
gagaccggcugaaccuag

SEQ ID NO: 2196 - RNA, 18 nt, Homo sapiens
ugaagcagaugccuuugg

SEQ ID NO: 2197 - RNA, 18 nt, Homo sapiens
gaaaccuguccacuuacc

SEQ ID NO: 2198 - RNA, 18 nt, Homo sapiens
ucagccagcucuggauuu

SEQ ID NO: 2199 - RNA, 18 nt, Homo sapiens
acuuccugaccuuggagc

SEQ ID NO: 2200 - RNA, 18 nt, Homo sapiens
uguuacagcuuccaagug

SEQ ID NO: 2201 - RNA, 18 nt, Homo sapiens
agauccagauuaugucag

SEQ ID NO: 2202 - RNA, 18 nt, Homo sapiens
ggccccugauuauacuac

SEQ ID NO: 2203 - RNA, 18 nt, Homo sapiens
uguaccagaccaugcugg

SEQ ID NO: 2204 - RNA, 18 nt, Homo sapiens
cuggacugcuggcacggg

SEQ ID NO: 2205 - RNA, 18 nt, Homo sapiens
ucucucugccuaccucac

SEQ ID NO: 2206 - RNA, 18 nt, Homo sapiens
cucaccuguuuccuguau

SEQ ID NO: 2207 - RNA, 18 nt, Homo sapiens
agagccggccugugagug

SEQ ID NO: 2208 - RNA, 18 nt, Homo sapiens
aaucccagaugacaacca

SEQ ID NO: 2209 - RNA, 18 nt, Homo sapiens
acaaccagacggacagug

SEQ ID NO: 2210 - RNA, 18 nt, Homo sapiens
gcuaccaguccggauauc

SEQ ID NO: 2211 - RNA, 18 nt, Homo sapiens
ucacuccgaugacacaga

SEQ ID NO: 2212 - RNA, 18 nt, Homo sapiens
uagcacagcccagauucu

SEQ ID NO: 2213 - RNA, 18 nt, Homo sapiens
cagcccagauucuccagc

SEQ ID NO: 2214 - RNA, 18 nt, Homo sapiens
uucuccagccugacacgg

SEQ ID NO: 2215 - RNA, 18 nt, Homo sapiens
uccuccuguuuaaaagga

SEQ ID NO: 2216 - RNA, 18 nt, Homo sapiens
gaggucugcucagauuuu

SEQ ID NO: 2217 - RNA, 18 nt, Homo sapiens
cugcucagauuuugaagu

SEQ ID NO: 2218 - RNA, 18 nt, Homo sapiens
gaccucggacugcaggga

SEQ ID NO: 2219 - RNA, 18 nt, Homo sapiens
ggagccagcucuucuagg

SEQ ID NO: 2220 - RNA, 17 nt, Mus musculus
gggcgaauuggguacgg

SEQ ID NO: 2221 - RNA, 17 nt, Mus musculus
aauuggguacgggaccc

SEQ ID NO: 2222 - RNA, 17 nt, Mus musculus
accccccucgaggucga

SEQ ID NO: 2223 - RNA, 17 nt, Mus musculus
cucgaggucgacgguau

SEQ ID NO: 2224 - RNA, 17 nt, Mus musculus
ucgacgguaucgauaag

SEQ ID NO: 2225 - RNA, 17 nt, Mus musculus
gacgguaucgauaagcu

SEQ ID NO: 2226 - RNA, 17 nt, Mus musculus
guaucgauaagcuugau

SEQ ID NO: 2227 - RNA, 17 nt, Mus musculus
gauaagcuugauaucga

SEQ ID NO: 2228 - RNA, 17 nt, Mus musculus
agcuugauaucgaauuc

SEQ ID NO: 2229 - RNA, 17 nt, Mus musculus
cuugauaucgaauucgg

SEQ ID NO: 2230 - RNA, 17 nt, Mus musculus
uaucgaauucgggccca

SEQ ID NO: 2231 - RNA, 17 nt, Mus musculus
aucgaauucgggcccag

SEQ ID NO: 2232 - RNA, 17 nt, Mus musculus
gacugugucccgcagcc

SEQ ID NO: 2233 - RNA, 17 nt, Mus musculus
gccgggauaaccuggcu

SEQ ID NO: 2234 - RNA, 17 nt, Mus musculus
gacccgauuccgcggac

SEQ ID NO: 2235 - RNA, 17 nt, Mus musculus
acccgauuccgcggaca

SEQ ID NO: 2236 - RNA, 17 nt, Mus musculus
cccgcgcucuccccggu

SEQ ID NO: 2237 - RNA, 17 nt, Mus musculus
cgcgcucuccccggucu

SEQ ID NO: 2238 - RNA, 17 nt, Mus musculus
uccccggucuugcgcug

SEQ ID NO: 2239 - RNA, 17 nt, Mus musculus
cccggucuugcgcugcg

SEQ ID NO: 2240 - RNA, 17 nt, Mus musculus
ggggccauaccgccucu

SEQ ID NO: 2241 - RNA, 17 nt, Mus musculus
uaccgccucugugacuu

SEQ ID NO: 2242 - RNA, 17 nt, Mus musculus
cugugacuucuuugcgg

SEQ ID NO: 2243 - RNA, 17 nt, Mus musculus
ugugacuucuuugcggg

SEQ ID NO: 2244 - RNA, 17 nt, Mus musculus
ugacuucuuugcgggcc

SEQ ID NO: 2245 - RNA, 17 nt, Mus musculus
gacuucuuugcgggcca

SEQ ID NO: 2246 - RNA, 17 nt, Mus musculus
gaaggagucugugccug

SEQ ID NO: 2247 - RNA, 17 nt, Mus musculus
acugggcucugugccca

SEQ ID NO: 2248 - RNA, 17 nt, Mus musculus
gcgcugcuagcugucgc

SEQ ID NO: 2249 - RNA, 17 nt, Mus musculus
cuagcugucgcucugug

SEQ ID NO: 2250 - RNA, 17 nt, Mus musculus
cugucgcucugugguuc

SEQ ID NO: 2251 - RNA, 17 nt, Mus musculus
ucugugguucugcgugg

SEQ ID NO: 2252 - RNA, 17 nt, Mus musculus
cugugguucugcgugga

SEQ ID NO: 2253 - RNA, 17 nt, Mus musculus
agccgccucuguggguu

SEQ ID NO: 2254 - RNA, 17 nt, Mus musculus
cuguggguuugacuggc

SEQ ID NO: 2255 - RNA, 17 nt, Mus musculus
uguggguuugacuggcg

SEQ ID NO: 2256 - RNA, 17 nt, Mus musculus
cuggcgauuuucuccau

SEQ ID NO: 2257 - RNA, 17 nt, Mus musculus
uggcgauuuucuccauc

SEQ ID NO: 2258 - RNA, 17 nt, Mus musculus
ggcgauuuucuccaucc

SEQ ID NO: 2259 - RNA, 17 nt, Mus musculus
gcgauuuucuccauccc

SEQ ID NO: 2260 - RNA, 17 nt, Mus musculus
gauuuucuccauccccc

SEQ ID NO: 2261 - RNA, 17 nt, Mus musculus
uucuccauccccccaag

SEQ ID NO: 2262 - RNA, 17 nt, Mus musculus
cccaagcucagcacaca

SEQ ID NO: 2263 - RNA, 17 nt, Mus musculus
aaagacauacugacaau

SEQ ID NO: 2264 - RNA, 17 nt, Mus musculus
cugacaauuuuggcaaa

SEQ ID NO: 2265 - RNA, 17 nt, Mus musculus
ugacaauuuuggcaaau

SEQ ID NO: 2266 - RNA, 17 nt, Mus musculus
gacaauuuuggcaaaua

SEQ ID NO: 2267 - RNA, 17 nt, Mus musculus
uggcaaauacaacccuu

SEQ ID NO: 2268 - RNA, 17 nt, Mus musculus
acaacccuucagauuac

SEQ ID NO: 2269 - RNA, 17 nt, Mus musculus
caacccuucagauuacu

SEQ ID NO: 2270 - RNA, 17 nt, Mus musculus
cuucagauuacuugcag

SEQ ID NO: 2271 - RNA, 17 nt, Mus musculus
uucagauuacuugcagg

SEQ ID NO: 2272 - RNA, 17 nt, Mus musculus
agauuacuugcagggga

SEQ ID NO: 2273 - RNA, 17 nt, Mus musculus
ccaaugcucagcgugau

SEQ ID NO: 2274 - RNA, 17 nt, Mus musculus
agcgugauucugaggaa

SEQ ID NO: 2275 - RNA, 17 nt, Mus musculus
gcgugauucugaggaaa

SEQ ID NO: 2276 - RNA, 17 nt, Mus musculus
gaaaggguauuggugac

SEQ ID NO: 2277 - RNA, 17 nt, Mus musculus
aaggguauuggugacug

SEQ ID NO: 2278 - RNA, 17 nt, Mus musculus
gugacaguaucuucugc

SEQ ID NO: 2279 - RNA, 17 nt, Mus musculus
gacaguaucuucugcaa

SEQ ID NO: 2280 - RNA, 17 nt, Mus musculus
caguaucuucugcaaaa

SEQ ID NO: 2281 - RNA, 17 nt, Mus musculus
aguaucuucugcaaaac

SEQ ID NO: 2282 - RNA, 17 nt, Mus musculus
aaaacacucaccauucc

SEQ ID NO: 2283 - RNA, 17 nt, Mus musculus
cucaccauucccagggu

SEQ ID NO: 2284 - RNA, 17 nt, Mus musculus
ucaccauucccagggug

SEQ ID NO: 2285 - RNA, 17 nt, Mus musculus
agggugguuggaaauga

SEQ ID NO: 2286 - RNA, 17 nt, Mus musculus
gaaaugauacuggagcc

SEQ ID NO: 2287 - RNA, 17 nt, Mus musculus
caagugcucguaccggg

SEQ ID NO: 2288 - RNA, 17 nt, Mus musculus
gugcucguaccgggacg

SEQ ID NO: 2289 - RNA, 17 nt, Mus musculus
cgggacgucgacauagc

SEQ ID NO: 2290 - RNA, 17 nt, Mus musculus
gucgacauagccuccac

SEQ ID NO: 2291 - RNA, 17 nt, Mus musculus
cauagccuccacuguuu

SEQ ID NO: 2292 - RNA, 17 nt, Mus musculus
uccacuguuuaugucua

SEQ ID NO: 2293 - RNA, 17 nt, Mus musculus
ccacuguuuaugucuau

SEQ ID NO: 2294 - RNA, 17 nt, Mus musculus
cacuguuuaugucuaug

SEQ ID NO: 2295 - RNA, 17 nt, Mus musculus
guuuaugucuauguucg

SEQ ID NO: 2296 - RNA, 17 nt, Mus musculus
uuaugucuauguucgag

SEQ ID NO: 2297 - RNA, 17 nt, Mus musculus
gucuauguucgagauua

SEQ ID NO: 2298 - RNA, 17 nt, Mus musculus
ucuauguucgagauuac

SEQ ID NO: 2299 - RNA, 17 nt, Mus musculus
uucgagauuacagauca

SEQ ID NO: 2300 - RNA, 17 nt, Mus musculus
ucgagauuacagaucac

SEQ ID NO: 2301 - RNA, 17 nt, Mus musculus
uuacagaucaccauuca

SEQ ID NO: 2302 - RNA, 17 nt, Mus musculus
aucaccauucaucgccu

SEQ ID NO: 2303 - RNA, 17 nt, Mus musculus
ucaccauucaucgccuc

SEQ ID NO: 2304 - RNA, 17 nt, Mus musculus
ccauucaucgccucugu

SEQ ID NO: 2305 - RNA, 17 nt, Mus musculus
caucgccucugucagug

SEQ ID NO: 2306 - RNA, 17 nt, Mus musculus
gccucugucagugacca

SEQ ID NO: 2307 - RNA, 17 nt, Mus musculus
cauggcaucguguacau

SEQ ID NO: 2308 - RNA, 17 nt, Mus musculus
caucguguacaucaccg

SEQ ID NO: 2309 - RNA, 17 nt, Mus musculus
guguacaucaccgagaa

SEQ ID NO: 2310 - RNA, 17 nt, Mus musculus
guggugauccccugccg

SEQ ID NO: 2311 - RNA, 17 nt, Mus musculus
ccgagggucgauuucaa

SEQ ID NO: 2312 - RNA, 17 nt, Mus musculus
gggucgauuucaaaccu

SEQ ID NO: 2313 - RNA, 17 nt, Mus musculus
ggucgauuucaaaccuc

SEQ ID NO: 2314 - RNA, 17 nt, Mus musculus
gucgauuucaaaccuca

SEQ ID NO: 2315 - RNA, 17 nt, Mus musculus
ucaaaccucaauguguc

SEQ ID NO: 2316 - RNA, 17 nt, Mus musculus
caaugugucucuuugcg

SEQ ID NO: 2317 - RNA, 17 nt, Mus musculus
augugucucuuugcgcu

SEQ ID NO: 2318 - RNA, 17 nt, Mus musculus
gugucucuuugcgcuag

SEQ ID NO: 2319 - RNA, 17 nt, Mus musculus
ugucucuuugcgcuagg

SEQ ID NO: 2320 - RNA, 17 nt, Mus musculus
uuugcgcuagguaucca

SEQ ID NO: 2321 - RNA, 17 nt, Mus musculus
cgcuagguauccagaaa

SEQ ID NO: 2322 - RNA, 17 nt, Mus musculus
cuagguauccagaaaag

SEQ ID NO: 2323 - RNA, 17 nt, Mus musculus
aaagagauuuguuccgg

SEQ ID NO: 2324 - RNA, 17 nt, Mus musculus
aagagauuuguuccgga

SEQ ID NO: 2325 - RNA, 17 nt, Mus musculus
agauuuguuccggaugg

SEQ ID NO: 2326 - RNA, 17 nt, Mus musculus
gauuuguuccggaugga

SEQ ID NO: 2327 - RNA, 17 nt, Mus musculus
agcgagauaggcuuuac

SEQ ID NO: 2328 - RNA, 17 nt, Mus musculus
gauaggcuuuacucucc

SEQ ID NO: 2329 - RNA, 17 nt, Mus musculus
auaggcuuuacucuccc

SEQ ID NO: 2330 - RNA, 17 nt, Mus musculus
uaggcuuuacucucccc

SEQ ID NO: 2331 - RNA, 17 nt, Mus musculus
gcuuuacucuccccagu

SEQ ID NO: 2332 - RNA, 17 nt, Mus musculus
uuuacucuccccaguua

SEQ ID NO: 2333 - RNA, 17 nt, Mus musculus
uccccaguuacaugauc

SEQ ID NO: 2334 - RNA, 17 nt, Mus musculus
ccccaguuacaugauca

SEQ ID NO: 2335 - RNA, 17 nt, Mus musculus
gaucagcuaugccggca

SEQ ID NO: 2336 - RNA, 17 nt, Mus musculus
cauggucuucugugagg

SEQ ID NO: 2337 - RNA, 17 nt, Mus musculus
auggucuucugugaggc

SEQ ID NO: 2338 - RNA, 17 nt, Mus musculus
gcaaagaucaaugauga

SEQ ID NO: 2339 - RNA, 17 nt, Mus musculus
ugaaaccuaucagucua

SEQ ID NO: 2340 - RNA, 17 nt, Mus musculus
aaaccuaucagucuauc

SEQ ID NO: 2341 - RNA, 17 nt, Mus musculus
cuaucagucuaucaugu

SEQ ID NO: 2342 - RNA, 17 nt, Mus musculus
aucagucuaucauguac

SEQ ID NO: 2343 - RNA, 17 nt, Mus musculus
cagucuaucauguacau

SEQ ID NO: 2344 - RNA, 17 nt, Mus musculus
uaucauguacauaguug

SEQ ID NO: 2345 - RNA, 17 nt, Mus musculus
auguacauaguuguggu

SEQ ID NO: 2346 - RNA, 17 nt, Mus musculus
uacauaguugugguugu

SEQ ID NO: 2347 - RNA, 17 nt, Mus musculus
guugugguuguaggaua

SEQ ID NO: 2348 - RNA, 17 nt, Mus musculus
gugguuguaggauauag

SEQ ID NO: 2349 - RNA, 17 nt, Mus musculus
uguaggauauaggauuu

SEQ ID NO: 2350 - RNA, 17 nt, Mus musculus
uaggauauaggauuuau

SEQ ID NO: 2351 - RNA, 17 nt, Mus musculus
uaggauuuaugauguga

SEQ ID NO: 2352 - RNA, 17 nt, Mus musculus
gaugugauucugagccc

SEQ ID NO: 2353 - RNA, 17 nt, Mus musculus
augugauucugagcccc

SEQ ID NO: 2354 - RNA, 17 nt, Mus musculus
caugaaauugagcuauc

SEQ ID NO: 2355 - RNA, 17 nt, Mus musculus
auugagcuaucugccgg

SEQ ID NO: 2356 - RNA, 17 nt, Mus musculus
ugagcuaucugccggag

SEQ ID NO: 2357 - RNA, 17 nt, Mus musculus
gaaaaacuugucuuaaa

SEQ ID NO: 2358 - RNA, 17 nt, Mus musculus
aaacuugucuuaaauug

SEQ ID NO: 2359 - RNA, 17 nt, Mus musculus
acuugucuuaaauugua

SEQ ID NO: 2360 - RNA, 17 nt, Mus musculus
ucuuaaauuguacagcg

SEQ ID NO: 2361 - RNA, 17 nt, Mus musculus
uaaauuguacagcgaga

SEQ ID NO: 2362 - RNA, 17 nt, Mus musculus
acagagcucaauguggg

SEQ ID NO: 2363 - RNA, 17 nt, Mus musculus
guggggcuugauuucac

SEQ ID NO: 2364 - RNA, 17 nt, Mus musculus
ggcuugauuucaccugg

SEQ ID NO: 2365 - RNA, 17 nt, Mus musculus
gcuugauuucaccuggc

SEQ ID NO: 2366 - RNA, 17 nt, Mus musculus
cuugauuucaccuggca

SEQ ID NO: 2367 - RNA, 17 nt, Mus musculus
cuggcacucuccaccuu

SEQ ID NO: 2368 - RNA, 17 nt, Mus musculus
ggcacucuccaccuuca

SEQ ID NO: 2369 - RNA, 17 nt, Mus musculus
cuccaccuucaaagucu

SEQ ID NO: 2370 - RNA, 17 nt, Mus musculus
uccaccuucaaagucuc

SEQ ID NO: 2371 - RNA, 17 nt, Mus musculus
uucaaagucucaucaua

SEQ ID NO: 2372 - RNA, 17 nt, Mus musculus
caaagucucaucauaag

SEQ ID NO: 2373 - RNA, 17 nt, Mus musculus
agucucaucauaagaag

SEQ ID NO: 2374 - RNA, 17 nt, Mus musculus
cucaucauaagaagauu

SEQ ID NO: 2375 - RNA, 17 nt, Mus musculus
aagaagauuguaaaccg

SEQ ID NO: 2376 - RNA, 17 nt, Mus musculus
aagauuguaaaccggga

SEQ ID NO: 2377 - RNA, 17 nt, Mus musculus
gaaacccuuuccuggga

SEQ ID NO: 2378 - RNA, 17 nt, Mus musculus
aaacccuuuccugggac

SEQ ID NO: 2379 - RNA, 17 nt, Mus musculus
aacccuuuccugggacu

SEQ ID NO: 2380 - RNA, 17 nt, Mus musculus
gaagauguuuuugagca

SEQ ID NO: 2381 - RNA, 17 nt, Mus musculus
aagauguuuuugagcac

SEQ ID NO: 2382 - RNA, 17 nt, Mus musculus
agauguuuuugagcacc

SEQ ID NO: 2383 - RNA, 17 nt, Mus musculus
gauguuuuugagcaccu

SEQ ID NO: 2384 - RNA, 17 nt, Mus musculus
gagcaccuugacaauag

SEQ ID NO: 2385 - RNA, 17 nt, Mus musculus
uugacaauagaaagugu

SEQ ID NO: 2386 - RNA, 17 nt, Mus musculus
aggggaauacaccugug

SEQ ID NO: 2387 - RNA, 17 nt, Mus musculus
accuguguagcguccag

SEQ ID NO: 2388 - RNA, 17 nt, Mus musculus
uguagcguccaguggac

SEQ ID NO: 2389 - RNA, 17 nt, Mus musculus
cggaugaucaagagaaa

SEQ ID NO: 2390 - RNA, 17 nt, Mus musculus
agagaaauagaacauuu

SEQ ID NO: 2391 - RNA, 17 nt, Mus musculus
uagaacauuuguccgag

SEQ ID NO: 2392 - RNA, 17 nt, Mus musculus
agaacauuuguccgagu

SEQ ID NO: 2393 - RNA, 17 nt, Mus musculus
acauuuguccgaguuca

SEQ ID NO: 2394 - RNA, 17 nt, Mus musculus
guccgaguucacacaaa

SEQ ID NO: 2395 - RNA, 17 nt, Mus musculus
uccgaguucacacaaag

SEQ ID NO: 2396 - RNA, 17 nt, Mus musculus
caaagccuuuuauugcu

SEQ ID NO: 2397 - RNA, 17 nt, Mus musculus
aaagccuuuuauugcuu

SEQ ID NO: 2398 - RNA, 17 nt, Mus musculus
aagccuuuuauugcuuu

SEQ ID NO: 2399 - RNA, 17 nt, Mus musculus
agccuuuuauugcuuuc

SEQ ID NO: 2400 - RNA, 17 nt, Mus musculus
ccuuuuauugcuuucgg

SEQ ID NO: 2401 - RNA, 17 nt, Mus musculus
uuauugcuuucgguagu

SEQ ID NO: 2402 - RNA, 17 nt, Mus musculus
uauugcuuucgguagug

SEQ ID NO: 2403 - RNA, 17 nt, Mus musculus
auugcuuucgguagugg

SEQ ID NO: 2404 - RNA, 17 nt, Mus musculus
cuuucgguagugggaug

SEQ ID NO: 2405 - RNA, 17 nt, Mus musculus
gaugaaaucuuuggugg

SEQ ID NO: 2406 - RNA, 17 nt, Mus musculus
ugaaaucuuugguggaa

SEQ ID NO: 2407 - RNA, 17 nt, Mus musculus
gaaaucuuugguggaag

SEQ ID NO: 2408 - RNA, 17 nt, Mus musculus
ugggcagucaaguccga

SEQ ID NO: 2409 - RNA, 17 nt, Mus musculus
agucaaguccgaauccc

SEQ ID NO: 2410 - RNA, 17 nt, Mus musculus
guccgaaucccugugaa

SEQ ID NO: 2411 - RNA, 17 nt, Mus musculus
ugugaaguaucucaguu

SEQ ID NO: 2412 - RNA, 17 nt, Mus musculus
ugaaguaucucaguuac

SEQ ID NO: 2413 - RNA, 17 nt, Mus musculus
aaguaucucaguuaccc

SEQ ID NO: 2414 - RNA, 17 nt, Mus musculus
aucucaguuacccagcu

SEQ ID NO: 2415 - RNA, 17 nt, Mus musculus
ucucaguuacccagcuc

SEQ ID NO: 2416 - RNA, 17 nt, Mus musculus
acccagcuccugauauc

SEQ ID NO: 2417 - RNA, 17 nt, Mus musculus
cuccugauaucaaaugg

SEQ ID NO: 2418 - RNA, 17 nt, Mus musculus
ccugauaucaaauggua

SEQ ID NO: 2419 - RNA, 17 nt, Mus musculus
caaaugguacagaaaug

SEQ ID NO: 2420 - RNA, 17 nt, Mus musculus
aggcccauugaguccaa

SEQ ID NO: 2421 - RNA, 17 nt, Mus musculus
cauugaguccaacuaca

SEQ ID NO: 2422 - RNA, 17 nt, Mus musculus
guccaacuacacaauga

SEQ ID NO: 2423 - RNA, 17 nt, Mus musculus
acaaugauuguuggcga

SEQ ID NO: 2424 - RNA, 17 nt, Mus musculus
augauuguuggcgauga

SEQ ID NO: 2425 - RNA, 17 nt, Mus musculus
gaugaacucaccaucau

SEQ ID NO: 2426 - RNA, 17 nt, Mus musculus
cucaccaucauggaagu

SEQ ID NO: 2427 - RNA, 17 nt, Mus musculus
aggaaacuacacgguca

SEQ ID NO: 2428 - RNA, 17 nt, Mus musculus
uacacggucauccucac

SEQ ID NO: 2429 - RNA, 17 nt, Mus musculus
acggucauccucaccaa

SEQ ID NO: 2430 - RNA, 17 nt, Mus musculus
gucauccucaccaaccc

SEQ ID NO: 2431 - RNA, 17 nt, Mus musculus
aaccccauuucaaugga

SEQ ID NO: 2432 - RNA, 17 nt, Mus musculus
accccauuucaauggag

SEQ ID NO: 2433 - RNA, 17 nt, Mus musculus
ccccauuucaauggaga

SEQ ID NO: 2434 - RNA, 17 nt, Mus musculus
cacauggucucucuggu

SEQ ID NO: 2435 - RNA, 17 nt, Mus musculus
cauggucucucugguug

SEQ ID NO: 2436 - RNA, 17 nt, Mus musculus
ucucugguugugaaugu

SEQ ID NO: 2437 - RNA, 17 nt, Mus musculus
gugaaugucccacccca

SEQ ID NO: 2438 - RNA, 17 nt, Mus musculus
ccccagaucggugagaa

SEQ ID NO: 2439 - RNA, 17 nt, Mus musculus
gaaagccuugaucucgc

SEQ ID NO: 2440 - RNA, 17 nt, Mus musculus
gccuugaucucgccuau

SEQ ID NO: 2441 - RNA, 17 nt, Mus musculus
cuugaucucgccuaugg

SEQ ID NO: 2442 - RNA, 17 nt, Mus musculus
ucucgccuauggauucc

SEQ ID NO: 2443 - RNA, 17 nt, Mus musculus
cuauggauuccuaccag

SEQ ID NO: 2444 - RNA, 17 nt, Mus musculus
uauggauuccuaccagu

SEQ ID NO: 2445 - RNA, 17 nt, Mus musculus
ggauuccuaccaguaug

SEQ ID NO: 2446 - RNA, 17 nt, Mus musculus
cuaccaguaugggacca

SEQ ID NO: 2447 - RNA, 17 nt, Mus musculus
gcagacauugacaugca

SEQ ID NO: 2448 - RNA, 17 nt, Mus musculus
ugcacagucuacgccaa

SEQ ID NO: 2449 - RNA, 17 nt, Mus musculus
cacagucuacgccaacc

SEQ ID NO: 2450 - RNA, 17 nt, Mus musculus
ccaacccuccccugcac

SEQ ID NO: 2451 - RNA, 17 nt, Mus musculus
caccacauccaguggua

SEQ ID NO: 2452 - RNA, 17 nt, Mus musculus
ccagugguacuggcagc

SEQ ID NO: 2453 - RNA, 17 nt, Mus musculus
uggcagcuagaagaagc

SEQ ID NO: 2454 - RNA, 17 nt, Mus musculus
agccugcuccuacagac

SEQ ID NO: 2455 - RNA, 17 nt, Mus musculus
cugcuccuacagacccg

SEQ ID NO: 2456 - RNA, 17 nt, Mus musculus
aagcccguaugcuugua

SEQ ID NO: 2457 - RNA, 17 nt, Mus musculus
cguaugcuuguaaagaa

SEQ ID NO: 2458 - RNA, 17 nt, Mus musculus
augcuuguaaagaaugg

SEQ ID NO: 2459 - RNA, 17 nt, Mus musculus
uggaggauuuccagggg

SEQ ID NO: 2460 - RNA, 17 nt, Mus musculus
ggaggauuuccaggggg

SEQ ID NO: 2461 - RNA, 17 nt, Mus musculus
gaggauuuccagggggg

SEQ ID NO: 2462 - RNA, 17 nt, Mus musculus
aacaagaucgaagucac

SEQ ID NO: 2463 - RNA, 17 nt, Mus musculus
aucgaagucaccaaaaa

SEQ ID NO: 2464 - RNA, 17 nt, Mus musculus
aaaccaauaugcccuga

SEQ ID NO: 2465 - RNA, 17 nt, Mus musculus
gcccugauugaaggaaa

SEQ ID NO: 2466 - RNA, 17 nt, Mus musculus
aaaacuguaaguacgcu

SEQ ID NO: 2467 - RNA, 17 nt, Mus musculus
cuguaaguacgcugguc

SEQ ID NO: 2468 - RNA, 17 nt, Mus musculus
acgcuggucauccaagc

SEQ ID NO: 2469 - RNA, 17 nt, Mus musculus
cuggucauccaagcugc

SEQ ID NO: 2470 - RNA, 17 nt, Mus musculus
caacgugucagcguugu

SEQ ID NO: 2471 - RNA, 17 nt, Mus musculus
gucagcguuguacaaau

SEQ ID NO: 2472 - RNA, 17 nt, Mus musculus
agcguuguacaaaugug

SEQ ID NO: 2473 - RNA, 17 nt, Mus musculus
gaagccaucaacaaagc

SEQ ID NO: 2474 - RNA, 17 nt, Mus musculus
gagagggucaucuccuu

SEQ ID NO: 2475 - RNA, 17 nt, Mus musculus
agggucaucuccuucca

SEQ ID NO: 2476 - RNA, 17 nt, Mus musculus
ggucaucuccuuccaug

SEQ ID NO: 2477 - RNA, 17 nt, Mus musculus
caucuccuuccauguga

SEQ ID NO: 2478 - RNA, 17 nt, Mus musculus
aucuccuuccaugugau

SEQ ID NO: 2479 - RNA, 17 nt, Mus musculus
caugugaucaggggucc

SEQ ID NO: 2480 - RNA, 17 nt, Mus musculus
ucagggguccugaaauu

SEQ ID NO: 2481 - RNA, 17 nt, Mus musculus
ccugaaauuacugugca

SEQ ID NO: 2482 - RNA, 17 nt, Mus musculus
cugaaauuacugugcaa

SEQ ID NO: 2483 - RNA, 17 nt, Mus musculus
gagugugucccuguugu

SEQ ID NO: 2484 - RNA, 17 nt, Mus musculus
gucccuguugugcacug

SEQ ID NO: 2485 - RNA, 17 nt, Mus musculus
acagaaauacguuugag

SEQ ID NO: 2486 - RNA, 17 nt, Mus musculus
aaauacguuugagaacc

SEQ ID NO: 2487 - RNA, 17 nt, Mus musculus
aauacguuugagaaccu

SEQ ID NO: 2488 - RNA, 17 nt, Mus musculus
gagaaccucacguggua

SEQ ID NO: 2489 - RNA, 17 nt, Mus musculus
cacgugguacaagcuug

SEQ ID NO: 2490 - RNA, 17 nt, Mus musculus
uacaagcuuggcucaca

SEQ ID NO: 2491 - RNA, 17 nt, Mus musculus
gcuuggcucacaggcaa

SEQ ID NO: 2492 - RNA, 17 nt, Mus musculus
ggcaacaucgguccaca

SEQ ID NO: 2493 - RNA, 17 nt, Mus musculus
acaucgguccacauggg

SEQ ID NO: 2494 - RNA, 17 nt, Mus musculus
gggcgaaucacucacac

SEQ ID NO: 2495 - RNA, 17 nt, Mus musculus
gaaucacucacaccagu

SEQ ID NO: 2496 - RNA, 17 nt, Mus musculus
acaccaguuugcaagaa

SEQ ID NO: 2497 - RNA, 17 nt, Mus musculus
caccaguuugcaagaac

SEQ ID NO: 2498 - RNA, 17 nt, Mus musculus
caagaacuuggaugcuc

SEQ ID NO: 2499 - RNA, 17 nt, Mus musculus
uggaugcucuuuggaaa

SEQ ID NO: 2500 - RNA, 17 nt, Mus musculus
gaugcucuuuggaaacu

SEQ ID NO: 2501 - RNA, 17 nt, Mus musculus
augcucuuuggaaacug

SEQ ID NO: 2502 - RNA, 17 nt, Mus musculus
caccauguuuucuaaca

SEQ ID NO: 2503 - RNA, 17 nt, Mus musculus
accauguuuucuaacag

SEQ ID NO: 2504 - RNA, 17 nt, Mus musculus
ccauguuuucuaacagc

SEQ ID NO: 2505 - RNA, 17 nt, Mus musculus
cauguuuucuaacagca

SEQ ID NO: 2506 - RNA, 17 nt, Mus musculus
uguuuucuaacagcaca

SEQ ID NO: 2507 - RNA, 17 nt, Mus musculus
aaugacaucuugauugu

SEQ ID NO: 2508 - RNA, 17 nt, Mus musculus
ugacaucuugauugugg

SEQ ID NO: 2509 - RNA, 17 nt, Mus musculus
aucuugauuguggcauu

SEQ ID NO: 2510 - RNA, 17 nt, Mus musculus
uguggcauuucagaaug

SEQ ID NO: 2511 - RNA, 17 nt, Mus musculus
guggcauuucagaaugc

SEQ ID NO: 2512 - RNA, 17 nt, Mus musculus
uggcauuucagaaugcc

SEQ ID NO: 2513 - RNA, 17 nt, Mus musculus
gaaugccucucugcagg

SEQ ID NO: 2514 - RNA, 17 nt, Mus musculus
augccucucugcaggac

SEQ ID NO: 2515 - RNA, 17 nt, Mus musculus
aggcgacuauguuugcu

SEQ ID NO: 2516 - RNA, 17 nt, Mus musculus
gacuauguuugcucugc

SEQ ID NO: 2517 - RNA, 17 nt, Mus musculus
acuauguuugcucugcu

SEQ ID NO: 2518 - RNA, 17 nt, Mus musculus
uguuugcucugcucaag

SEQ ID NO: 2519 - RNA, 17 nt, Mus musculus
gcucugcucaagauaag

SEQ ID NO: 2520 - RNA, 17 nt, Mus musculus
cucaagauaagaagacc

SEQ ID NO: 2521 - RNA, 17 nt, Mus musculus
aaagacauugccugguc

SEQ ID NO: 2522 - RNA, 17 nt, Mus musculus
ugccuggucaaacagcu

SEQ ID NO: 2523 - RNA, 17 nt, Mus musculus
aaacagcucaucauccu

SEQ ID NO: 2524 - RNA, 17 nt, Mus musculus
cagcucaucauccuaga

SEQ ID NO: 2525 - RNA, 17 nt, Mus musculus
cucaucauccuagagcg

SEQ ID NO: 2526 - RNA, 17 nt, Mus musculus
aucauccuagagcgcau

SEQ ID NO: 2527 - RNA, 17 nt, Mus musculus
cccaugaucaccggaaa

SEQ ID NO: 2528 - RNA, 17 nt, Mus musculus
ccggaaaucuggagaau

SEQ ID NO: 2529 - RNA, 17 nt, Mus musculus
uggagaaucagacaaca

SEQ ID NO: 2530 - RNA, 17 nt, Mus musculus
acaaccauuggcgagac

SEQ ID NO: 2531 - RNA, 17 nt, Mus musculus
gagaccauugaagugac

SEQ ID NO: 2532 - RNA, 17 nt, Mus musculus
aagugacuugcccagca

SEQ ID NO: 2533 - RNA, 17 nt, Mus musculus
cccagcaucuggaaauc

SEQ ID NO: 2534 - RNA, 17 nt, Mus musculus
cuggaaauccuacccca

SEQ ID NO: 2535 - RNA, 17 nt, Mus musculus
gaaauccuaccccacac

SEQ ID NO: 2536 - RNA, 17 nt, Mus musculus
ccacacauuacaugguu

SEQ ID NO: 2537 - RNA, 17 nt, Mus musculus
cacacauuacaugguuc

SEQ ID NO: 2538 - RNA, 17 nt, Mus musculus
uacaugguucaaagaca

SEQ ID NO: 2539 - RNA, 17 nt, Mus musculus
acaugguucaaagacaa

SEQ ID NO: 2540 - RNA, 17 nt, Mus musculus
acccugguagaagauuc

SEQ ID NO: 2541 - RNA, 17 nt, Mus musculus
uagaagauucaggcauu

SEQ ID NO: 2542 - RNA, 17 nt, Mus musculus
agaagauucaggcauug

SEQ ID NO: 2543 - RNA, 17 nt, Mus musculus
ucaggcauuguacugag

SEQ ID NO: 2544 - RNA, 17 nt, Mus musculus
ggcauuguacugagaga

SEQ ID NO: 2545 - RNA, 17 nt, Mus musculus
accugacuauccgcagg

SEQ ID NO: 2546 - RNA, 17 nt, Mus musculus
cugacuauccgcagggu

SEQ ID NO: 2547 - RNA, 17 nt, Mus musculus
ggaggccucuacaccug

SEQ ID NO: 2548 - RNA, 17 nt, Mus musculus
ugcaauguccuuggcug

SEQ ID NO: 2549 - RNA, 17 nt, Mus musculus
aauguccuuggcugugc

SEQ ID NO: 2550 - RNA, 17 nt, Mus musculus
gagacgcucuucauaau

SEQ ID NO: 2551 - RNA, 17 nt, Mus musculus
gacgcucuucauaauag

SEQ ID NO: 2552 - RNA, 17 nt, Mus musculus
acgcucuucauaauaga

SEQ ID NO: 2553 - RNA, 17 nt, Mus musculus
cucuucauaauagaagg

SEQ ID NO: 2554 - RNA, 17 nt, Mus musculus
gaccaacuuggaaguca

SEQ ID NO: 2555 - RNA, 17 nt, Mus musculus
uuggaagucauuauccu

SEQ ID NO: 2556 - RNA, 17 nt, Mus musculus
gaagucauuauccucgu

SEQ ID NO: 2557 - RNA, 17 nt, Mus musculus
aagucauuauccucguc

SEQ ID NO: 2558 - RNA, 17 nt, Mus musculus
gucauuauccucgucgg

SEQ ID NO: 2559 - RNA, 17 nt, Mus musculus
auuauccucgucggcac

SEQ ID NO: 2560 - RNA, 17 nt, Mus musculus
auccucgucggcacugc

SEQ ID NO: 2561 - RNA, 17 nt, Mus musculus
gcagugauugccauguu

SEQ ID NO: 2562 - RNA, 17 nt, Mus musculus
cauguucuucuggcucc

SEQ ID NO: 2563 - RNA, 17 nt, Mus musculus
auguucuucuggcuccu

SEQ ID NO: 2564 - RNA, 17 nt, Mus musculus
uucuggcuccuucuugu

SEQ ID NO: 2565 - RNA, 17 nt, Mus musculus
uggcuccuucuugucau

SEQ ID NO: 2566 - RNA, 17 nt, Mus musculus
ggcuccuucuugucauu

SEQ ID NO: 2567 - RNA, 17 nt, Mus musculus
cuccuucuugucauugu

SEQ ID NO: 2568 - RNA, 17 nt, Mus musculus
cuucuugucauuguccu

SEQ ID NO: 2569 - RNA, 17 nt, Mus musculus
cuugucauuguccuacg

SEQ ID NO: 2570 - RNA, 17 nt, Mus musculus
gucauuguccuacggac

SEQ ID NO: 2571 - RNA, 17 nt, Mus musculus
auuguccuacggaccgu

SEQ ID NO: 2572 - RNA, 17 nt, Mus musculus
cggaccguuaagcgggc

SEQ ID NO: 2573 - RNA, 17 nt, Mus musculus
gacaggcuacuugucua

SEQ ID NO: 2574 - RNA, 17 nt, Mus musculus
aggcuacuugucuauug

SEQ ID NO: 2575 - RNA, 17 nt, Mus musculus
cuacuugucuauuguca

SEQ ID NO: 2576 - RNA, 17 nt, Mus musculus
acuugucuauugucaug

SEQ ID NO: 2577 - RNA, 17 nt, Mus musculus
uugucuauugucaugga

SEQ ID NO: 2578 - RNA, 17 nt, Mus musculus
ucuauugucauggaucc

SEQ ID NO: 2579 - RNA, 17 nt, Mus musculus
agaugaauugcccuugg

SEQ ID NO: 2580 - RNA, 17 nt, Mus musculus
auugcccuuggaugagc

SEQ ID NO: 2581 - RNA, 17 nt, Mus musculus
ugaacgcuugccuuaug

SEQ ID NO: 2582 - RNA, 17 nt, Mus musculus
gcuugccuuaugaugcc

SEQ ID NO: 2583 - RNA, 17 nt, Mus musculus
cuugccuuaugaugcca

SEQ ID NO: 2584 - RNA, 17 nt, Mus musculus
gugggaauuccccaggg

SEQ ID NO: 2585 - RNA, 17 nt, Mus musculus
ugggaauuccccaggga

SEQ ID NO: 2586 - RNA, 17 nt, Mus musculus
cugaaacuaggaaaacc

SEQ ID NO: 2587 - RNA, 17 nt, Mus musculus
gaaaaccucuuggccgc

SEQ ID NO: 2588 - RNA, 17 nt, Mus musculus
aaaccucuuggccgcgg

SEQ ID NO: 2589 - RNA, 17 nt, Mus musculus
cggugccuucggccaag

SEQ ID NO: 2590 - RNA, 17 nt, Mus musculus
ggugccuucggccaagu

SEQ ID NO: 2591 - RNA, 17 nt, Mus musculus
caagugauugaggcaga

SEQ ID NO: 2592 - RNA, 17 nt, Mus musculus
cagacgcuuuuggaauu

SEQ ID NO: 2593 - RNA, 17 nt, Mus musculus
agacgcuuuuggaauug

SEQ ID NO: 2594 - RNA, 17 nt, Mus musculus
gacgcuuuuggaauuga

SEQ ID NO: 2595 - RNA, 17 nt, Mus musculus
cagcgacuugcaaaaca

SEQ ID NO: 2596 - RNA, 17 nt, Mus musculus
aaaacaguagccgucaa

SEQ ID NO: 2597 - RNA, 17 nt, Mus musculus
guagccgucaagauguu

SEQ ID NO: 2598 - RNA, 17 nt, Mus musculus
caagauguugaaagaag

SEQ ID NO: 2599 - RNA, 17 nt, Mus musculus
gcgagcaucgagcccuc

SEQ ID NO: 2600 - RNA, 17 nt, Mus musculus
cgagcccucaugucuga

SEQ ID NO: 2601 - RNA, 17 nt, Mus musculus
ccucaugucugaacuca

SEQ ID NO: 2602 - RNA, 17 nt, Mus musculus
cucaagauccucaucca

SEQ ID NO: 2603 - RNA, 17 nt, Mus musculus
aagauccucauccacau

SEQ ID NO: 2604 - RNA, 17 nt, Mus musculus
auccucauccacauugg

SEQ ID NO: 2605 - RNA, 17 nt, Mus musculus
auccacauuggucacca

SEQ ID NO: 2606 - RNA, 17 nt, Mus musculus
acauuggucaccaucuc

SEQ ID NO: 2607 - RNA, 17 nt, Mus musculus
gugaaccuccuaggcgc

SEQ ID NO: 2608 - RNA, 17 nt, Mus musculus
aaccuccuaggcgccug

SEQ ID NO: 2609 - RNA, 17 nt, Mus musculus
gagggccucucauggug

SEQ ID NO: 2610 - RNA, 17 nt, Mus musculus
gggccucucauggugau

SEQ ID NO: 2611 - RNA, 17 nt, Mus musculus
uguggaauucugcaagu

SEQ ID NO: 2612 - RNA, 17 nt, Mus musculus
guggaauucugcaaguu

SEQ ID NO: 2613 - RNA, 17 nt, Mus musculus
cugcaaguuuggaaacc

SEQ ID NO: 2614 - RNA, 17 nt, Mus musculus
ugcaaguuuggaaaccu

SEQ ID NO: 2615 - RNA, 17 nt, Mus musculus
ggaaaccuaucaacuua

SEQ ID NO: 2616 - RNA, 17 nt, Mus musculus
aaaccuaucaacuuacu

SEQ ID NO: 2617 - RNA, 17 nt, Mus musculus
uaucaacuuacuuacgg

SEQ ID NO: 2618 - RNA, 17 nt, Mus musculus
aucaacuuacuuacggg

SEQ ID NO: 2619 - RNA, 17 nt, Mus musculus
aacuuacuuacggggca

SEQ ID NO: 2620 - RNA, 17 nt, Mus musculus
acuuacuuacggggcaa

SEQ ID NO: 2621 - RNA, 17 nt, Mus musculus
aaaugaauuuguucccu

SEQ ID NO: 2622 - RNA, 17 nt, Mus musculus
aaugaauuuguucccua

SEQ ID NO: 2623 - RNA, 17 nt, Mus musculus
gaauuuguucccuauaa

SEQ ID NO: 2624 - RNA, 17 nt, Mus musculus
aauuuguucccuauaag

SEQ ID NO: 2625 - RNA, 17 nt, Mus musculus
uguucccuauaagagca

SEQ ID NO: 2626 - RNA, 17 nt, Mus musculus
uucccuauaagagcaaa

SEQ ID NO: 2627 - RNA, 17 nt, Mus musculus
ggcacgcuuccgccagg

SEQ ID NO: 2628 - RNA, 17 nt, Mus musculus
gcacgcuuccgccaggg

SEQ ID NO: 2629 - RNA, 17 nt, Mus musculus
caaggacuacguugggg

SEQ ID NO: 2630 - RNA, 17 nt, Mus musculus
gacuacguuggggagcu

SEQ ID NO: 2631 - RNA, 17 nt, Mus musculus
ggggagcucuccgugga

SEQ ID NO: 2632 - RNA, 17 nt, Mus musculus
ggagcucuccguggauc

SEQ ID NO: 2633 - RNA, 17 nt, Mus musculus
ccguggaucugaaaaga

SEQ ID NO: 2634 - RNA, 17 nt, Mus musculus
aagacgcuuggacagca

SEQ ID NO: 2635 - RNA, 17 nt, Mus musculus
gacagcaucaccagcag

SEQ ID NO: 2636 - RNA, 17 nt, Mus musculus
ccagagcucugccagcu

SEQ ID NO: 2637 - RNA, 17 nt, Mus musculus
ugccagcucaggcuuug

SEQ ID NO: 2638 - RNA, 17 nt, Mus musculus
cucaggcuuuguugagg

SEQ ID NO: 2639 - RNA, 17 nt, Mus musculus
ucaggcuuuguugagga

SEQ ID NO: 2640 - RNA, 17 nt, Mus musculus
ggcuuuguugaggagaa

SEQ ID NO: 2641 - RNA, 17 nt, Mus musculus
ggagaaaucgcucagug

SEQ ID NO: 2642 - RNA, 17 nt, Mus musculus
aaaucgcucagugaugu

SEQ ID NO: 2643 - RNA, 17 nt, Mus musculus
agugauguagaggaaga

SEQ ID NO: 2644 - RNA, 17 nt, Mus musculus
aagaagcuucugaagaa

SEQ ID NO: 2645 - RNA, 17 nt, Mus musculus
agaagcuucugaagaac

SEQ ID NO: 2646 - RNA, 17 nt, Mus musculus
agaacuguacaaggacu

SEQ ID NO: 2647 - RNA, 17 nt, Mus musculus
caaggacuuccugaccu

SEQ ID NO: 2648 - RNA, 17 nt, Mus musculus
ggaguucuuggcaucaa

SEQ ID NO: 2649 - RNA, 17 nt, Mus musculus
cuuggcaucaaggaagu

SEQ ID NO: 2650 - RNA, 17 nt, Mus musculus
ggaaguguauccacagg

SEQ ID NO: 2651 - RNA, 17 nt, Mus musculus
cgaaacauucuccuauc

SEQ ID NO: 2652 - RNA, 17 nt, Mus musculus
gaaacauucuccuaucg

SEQ ID NO: 2653 - RNA, 17 nt, Mus musculus
aacauucuccuaucgga

SEQ ID NO: 2654 - RNA, 17 nt, Mus musculus
auucuccuaucggagaa

SEQ ID NO: 2655 - RNA, 17 nt, Mus musculus
ucuccuaucggagaaga

SEQ ID NO: 2656 - RNA, 17 nt, Mus musculus
aaugugguuaagaucug

SEQ ID NO: 2657 - RNA, 17 nt, Mus musculus
augugguuaagaucugu

SEQ ID NO: 2658 - RNA, 17 nt, Mus musculus
guuaagaucugugacuu

SEQ ID NO: 2659 - RNA, 17 nt, Mus musculus
cugugacuucggcuugg

SEQ ID NO: 2660 - RNA, 17 nt, Mus musculus
ugugacuucggcuuggc

SEQ ID NO: 2661 - RNA, 17 nt, Mus musculus
cuucggcuuggcccggg

SEQ ID NO: 2662 - RNA, 17 nt, Mus musculus
cgggacauuuauaaaga

SEQ ID NO: 2663 - RNA, 17 nt, Mus musculus
gggacauuuauaaagac

SEQ ID NO: 2664 - RNA, 17 nt, Mus musculus
ggacauuuauaaagacc

SEQ ID NO: 2665 - RNA, 17 nt, Mus musculus
acauuuauaaagacccg

SEQ ID NO: 2666 - RNA, 17 nt, Mus musculus
acccggauuaugucaga

SEQ ID NO: 2667 - RNA, 17 nt, Mus musculus
cccggauuaugucagaa

SEQ ID NO: 2668 - RNA, 17 nt, Mus musculus
gcccgacucccuuugaa

SEQ ID NO: 2669 - RNA, 17 nt, Mus musculus
gacucccuuugaagugg

SEQ ID NO: 2670 - RNA, 17 nt, Mus musculus
acucccuuugaagugga

SEQ ID NO: 2671 - RNA, 17 nt, Mus musculus
gaaaccauuuuugacag

SEQ ID NO: 2672 - RNA, 17 nt, Mus musculus
aaaccauuuuugacaga

SEQ ID NO: 2673 - RNA, 17 nt, Mus musculus
aaccauuuuugacagag

SEQ ID NO: 2674 - RNA, 17 nt, Mus musculus
accauuuuugacagagu

SEQ ID NO: 2675 - RNA, 17 nt, Mus musculus
gacagaguauacacaau

SEQ ID NO: 2676 - RNA, 17 nt, Mus musculus
cagaguauacacaauuc

SEQ ID NO: 2677 - RNA, 17 nt, Mus musculus
uacacaauucagagcga

SEQ ID NO: 2678 - RNA, 17 nt, Mus musculus
acacaauucagagcgau

SEQ ID NO: 2679 - RNA, 17 nt, Mus musculus
uguguggucuuucggug

SEQ ID NO: 2680 - RNA, 17 nt, Mus musculus
uguggucuuucggugug

SEQ ID NO: 2681 - RNA, 17 nt, Mus musculus
guggucuuucggugugu

SEQ ID NO: 2682 - RNA, 17 nt, Mus musculus
uggucuuucgguguguu

SEQ ID NO: 2683 - RNA, 17 nt, Mus musculus
cgguguguugcucuggg

SEQ ID NO: 2684 - RNA, 17 nt, Mus musculus
guguugcucugggaaau

SEQ ID NO: 2685 - RNA, 17 nt, Mus musculus
auuuuccuuaggugccu

SEQ ID NO: 2686 - RNA, 17 nt, Mus musculus
uuuuccuuaggugccuc

SEQ ID NO: 2687 - RNA, 17 nt, Mus musculus
aggugccuccccauacc

SEQ ID NO: 2688 - RNA, 17 nt, Mus musculus
cuccccauacccugggg

SEQ ID NO: 2689 - RNA, 17 nt, Mus musculus
ccuggggucaagauuga

SEQ ID NO: 2690 - RNA, 17 nt, Mus musculus
gucaagauugaugaaga

SEQ ID NO: 2691 - RNA, 17 nt, Mus musculus
ugaagaauuuuguagga

SEQ ID NO: 2692 - RNA, 17 nt, Mus musculus
gaagaauuuuguaggag

SEQ ID NO: 2693 - RNA, 17 nt, Mus musculus
aagaauuuuguaggaga

SEQ ID NO: 2694 - RNA, 17 nt, Mus musculus
aauuuuguaggagauug

SEQ ID NO: 2695 - RNA, 17 nt, Mus musculus
uaggagauugaaagaag

SEQ ID NO: 2696 - RNA, 17 nt, Mus musculus
aaggaacuagaaugcgg

SEQ ID NO: 2697 - RNA, 17 nt, Mus musculus
ugcgggcuccugacuac

SEQ ID NO: 2698 - RNA, 17 nt, Mus musculus
uccugacuacacuaccc

SEQ ID NO: 2699 - RNA, 17 nt, Mus musculus
acuacacuaccccagaa

SEQ ID NO: 2700 - RNA, 17 nt, Mus musculus
gagacccucguuuucag

SEQ ID NO: 2701 - RNA, 17 nt, Mus musculus
acccucguuuucagagu

SEQ ID NO: 2702 - RNA, 17 nt, Mus musculus
cccucguuuucagaguu

SEQ ID NO: 2703 - RNA, 17 nt, Mus musculus
ccucguuuucagaguug

SEQ ID NO: 2704 - RNA, 17 nt, Mus musculus
cucguuuucagaguugg

SEQ ID NO: 2705 - RNA, 17 nt, Mus musculus
uucagaguugguggagc

SEQ ID NO: 2706 - RNA, 17 nt, Mus musculus
uggagcauuugggaaac

SEQ ID NO: 2707 - RNA, 17 nt, Mus musculus
ggagcauuugggaaacc

SEQ ID NO: 2708 - RNA, 17 nt, Mus musculus
ggaaaccuccugcaagc

SEQ ID NO: 2709 - RNA, 17 nt, Mus musculus
caaagacuauauuguuc

SEQ ID NO: 2710 - RNA, 17 nt, Mus musculus
aagacuauauuguucuu

SEQ ID NO: 2711 - RNA, 17 nt, Mus musculus
gacuauauuguucuucc

SEQ ID NO: 2712 - RNA, 17 nt, Mus musculus
uauauuguucuuccaau

SEQ ID NO: 2713 - RNA, 17 nt, Mus musculus
auauuguucuuccaaug

SEQ ID NO: 2714 - RNA, 17 nt, Mus musculus
auuguucuuccaauguc

SEQ ID NO: 2715 - RNA, 17 nt, Mus musculus
uuguucuuccaauguca

SEQ ID NO: 2716 - RNA, 17 nt, Mus musculus
uccaaugucagagacac

SEQ ID NO: 2717 - RNA, 17 nt, Mus musculus
ucuggacucucccugcc

SEQ ID NO: 2718 - RNA, 17 nt, Mus musculus
uggacucucccugccua

SEQ ID NO: 2719 - RNA, 17 nt, Mus musculus
cccugccuaccucaccu

SEQ ID NO: 2720 - RNA, 17 nt, Mus musculus
uuuccuguauggaggaa

SEQ ID NO: 2721 - RNA, 17 nt, Mus musculus
gcaggaaucagucauua

SEQ ID NO: 2722 - RNA, 17 nt, Mus musculus
gaaucagucauuaucuc

SEQ ID NO: 2723 - RNA, 17 nt, Mus musculus
ucagucauuaucuccag

SEQ ID NO: 2724 - RNA, 17 nt, Mus musculus
cagucauuaucuccaga

SEQ ID NO: 2725 - RNA, 17 nt, Mus musculus
gucauuaucuccagaac

SEQ ID NO: 2726 - RNA, 17 nt, Mus musculus
cauuaucuccagaacag

SEQ ID NO: 2727 - RNA, 17 nt, Mus musculus
uugaagauaucccauug

SEQ ID NO: 2728 - RNA, 17 nt, Mus musculus
gaagauaucccauugga

SEQ ID NO: 2729 - RNA, 17 nt, Mus musculus
uaucccauuggaggaac

SEQ ID NO: 2730 - RNA, 17 nt, Mus musculus
ccagaaguaaaagugau

SEQ ID NO: 2731 - RNA, 17 nt, Mus musculus
aaagugaucccagauga

SEQ ID NO: 2732 - RNA, 17 nt, Mus musculus
gggaugguccuugcauc

SEQ ID NO: 2733 - RNA, 17 nt, Mus musculus
augguccuugcaucaga

SEQ ID NO: 2734 - RNA, 17 nt, Mus musculus
ccuugcaucagaagagc

SEQ ID NO: 2735 - RNA, 17 nt, Mus musculus
ugaaaacucuggaagac

SEQ ID NO: 2736 - RNA, 17 nt, Mus musculus
gaacaaauuaucuccau

SEQ ID NO: 2737 - RNA, 17 nt, Mus musculus
aacaaauuaucuccauc

SEQ ID NO: 2738 - RNA, 17 nt, Mus musculus
ugcccaguaaaagcagg

SEQ ID NO: 2739 - RNA, 17 nt, Mus musculus
cagggagucuguggccu

SEQ ID NO: 2740 - RNA, 17 nt, Mus musculus
uguggccucggaaggcu

SEQ ID NO: 2741 - RNA, 17 nt, Mus musculus
ggaaggcuccaaccaga

SEQ ID NO: 2742 - RNA, 17 nt, Mus musculus
caguggcuaccagucug

SEQ ID NO: 2743 - RNA, 17 nt, Mus musculus
cuaccagucuggguauc

SEQ ID NO: 2744 - RNA, 17 nt, Mus musculus
gucuggguaucacucag

SEQ ID NO: 2745 - RNA, 17 nt, Mus musculus
cuggguaucacucagau

SEQ ID NO: 2746 - RNA, 17 nt, Mus musculus
guaucacucagaugaca

SEQ ID NO: 2747 - RNA, 17 nt, Mus musculus
caccguguacuccagcg

SEQ ID NO: 2748 - RNA, 17 nt, Mus musculus
cguguacuccagcgacg

SEQ ID NO: 2749 - RNA, 17 nt, Mus musculus
gcaggacuuuuaaagau

SEQ ID NO: 2750 - RNA, 17 nt, Mus musculus
caggacuuuuaaagaug

SEQ ID NO: 2751 - RNA, 17 nt, Mus musculus
aggacuuuuaaagaugg

SEQ ID NO: 2752 - RNA, 17 nt, Mus musculus
ggacuuuuaaagauggu

SEQ ID NO: 2753 - RNA, 17 nt, Mus musculus
gcugcaguucacgcuga

SEQ ID NO: 2754 - RNA, 17 nt, Mus musculus
cugcaguucacgcugac

SEQ ID NO: 2755 - RNA, 17 nt, Mus musculus
cgcugacucagggacca

SEQ ID NO: 2756 - RNA, 17 nt, Mus musculus
cugcagcucaccuccug

SEQ ID NO: 2757 - RNA, 17 nt, Mus musculus
gcucaccuccuguuuaa

SEQ ID NO: 2758 - RNA, 17 nt, Mus musculus
ccuccuguuuaaaugga

SEQ ID NO: 2759 - RNA, 17 nt, Mus musculus
cuccuguuuaaauggaa

SEQ ID NO: 2760 - RNA, 17 nt, Mus musculus
uccuguuuaaauggaag

SEQ ID NO: 2761 - RNA, 17 nt, Mus musculus
gaagugguccugucccg

SEQ ID NO: 2762 - RNA, 17 nt, Mus musculus
gguccugucccggcucc

SEQ ID NO: 2763 - RNA, 17 nt, Mus musculus
ucccggcuccgccccca

SEQ ID NO: 2764 - RNA, 17 nt, Mus musculus
ccccaacuccuggaaau

SEQ ID NO: 2765 - RNA, 17 nt, Mus musculus
cuggaaaucacgagaga

SEQ ID NO: 2766 - RNA, 17 nt, Mus musculus
gugcugcuuagauuuuc

SEQ ID NO: 2767 - RNA, 17 nt, Mus musculus
ugcugcuuagauuuuca

SEQ ID NO: 2768 - RNA, 17 nt, Mus musculus
gcuuagauuuucaagug

SEQ ID NO: 2769 - RNA, 17 nt, Mus musculus
cuuagauuuucaagugu

SEQ ID NO: 2770 - RNA, 17 nt, Mus musculus
uuagauuuucaaguguu

SEQ ID NO: 2771 - RNA, 17 nt, Mus musculus
uagauuuucaaguguug

SEQ ID NO: 2772 - RNA, 17 nt, Mus musculus
ucaaguguuguucuuuc

SEQ ID NO: 2773 - RNA, 17 nt, Mus musculus
guuguucuuuccaccac

SEQ ID NO: 2774 - RNA, 17 nt, Mus musculus
uuguucuuuccaccacc

SEQ ID NO: 2775 - RNA, 17 nt, Mus musculus
uguucuuuccaccaccc

SEQ ID NO: 2776 - RNA, 17 nt, Mus musculus
ccggaaguagccacauu

SEQ ID NO: 2777 - RNA, 17 nt, Mus musculus
agccacauuugauuuuc

SEQ ID NO: 2778 - RNA, 17 nt, Mus musculus
gccacauuugauuuuca

SEQ ID NO: 2779 - RNA, 17 nt, Mus musculus
cauuugauuuucauuuu

SEQ ID NO: 2780 - RNA, 17 nt, Mus musculus
auuugauuuucauuuuu

SEQ ID NO: 2781 - RNA, 17 nt, Mus musculus
uuugauuuucauuuuug

SEQ ID NO: 2782 - RNA, 17 nt, Mus musculus
uugauuuucauuuuugg

SEQ ID NO: 2783 - RNA, 17 nt, Mus musculus
auuuucauuuuuggagg

SEQ ID NO: 2784 - RNA, 17 nt, Mus musculus
uuuucauuuuuggagga

SEQ ID NO: 2785 - RNA, 17 nt, Mus musculus
uuucauuuuuggaggag

SEQ ID NO: 2786 - RNA, 17 nt, Mus musculus
uucauuuuuggaggagg

SEQ ID NO: 2787 - RNA, 17 nt, Mus musculus
agggaccucagacugca

SEQ ID NO: 2788 - RNA, 17 nt, Mus musculus
aaggagcuuguccucag

SEQ ID NO: 2789 - RNA, 17 nt, Mus musculus
gagcuuguccucagggc

SEQ ID NO: 2790 - RNA, 17 nt, Mus musculus
cuuguccucagggcauu

SEQ ID NO: 2791 - RNA, 17 nt, Mus musculus
cagggcauuuccagaga

SEQ ID NO: 2792 - RNA, 17 nt, Mus musculus
agggcauuuccagagaa

SEQ ID NO: 2793 - RNA, 17 nt, Mus musculus
gggcauuuccagagaag

SEQ ID NO: 2794 - RNA, 17 nt, Mus musculus
gaauguguugacucuac

SEQ ID NO: 2795 - RNA, 17 nt, Mus musculus
uguugacucuacucucu

SEQ ID NO: 2796 - RNA, 17 nt, Mus musculus
uugacucuacucucuuu

SEQ ID NO: 2797 - RNA, 17 nt, Mus musculus
acucuacucucuuuucc

SEQ ID NO: 2798 - RNA, 17 nt, Mus musculus
ucuacucucuuuuccau

SEQ ID NO: 2799 - RNA, 17 nt, Mus musculus
uacucucuuuuccauuc

SEQ ID NO: 2800 - RNA, 17 nt, Mus musculus
acucucuuuuccauuca

SEQ ID NO: 2801 - RNA, 17 nt, Mus musculus
cucucuuuuccauucau

SEQ ID NO: 2802 - RNA, 17 nt, Mus musculus
ucucuuuuccauucauu

SEQ ID NO: 2803 - RNA, 17 nt, Mus musculus
uuuuccauucauuuaaa

SEQ ID NO: 2804 - RNA, 17 nt, Mus musculus
uuuccauucauuuaaaa

SEQ ID NO: 2805 - RNA, 17 nt, Mus musculus
ccauucauuuaaaaguc

SEQ ID NO: 2806 - RNA, 17 nt, Mus musculus
cauucauuuaaaagucc

SEQ ID NO: 2807 - RNA, 17 nt, Mus musculus
auucauuuaaaaguccu

SEQ ID NO: 2808 - RNA, 17 nt, Mus musculus
uuaaaaguccuauauaa

SEQ ID NO: 2809 - RNA, 17 nt, Mus musculus
aaaguccuauauaaugu

SEQ ID NO: 2810 - RNA, 17 nt, Mus musculus
aguccuauauaaugugc

SEQ ID NO: 2811 - RNA, 17 nt, Mus musculus
uccuauauaaugugccc

SEQ ID NO: 2812 - RNA, 17 nt, Mus musculus
gcuguggucucacuacc

SEQ ID NO: 2813 - RNA, 17 nt, Mus musculus
uguggucucacuaccag

SEQ ID NO: 2814 - RNA, 17 nt, Mus musculus
gucucacuaccaguuaa

SEQ ID NO: 2815 - RNA, 17 nt, Mus musculus
cuaccaguuaaagcaaa

SEQ ID NO: 2816 - RNA, 17 nt, Mus musculus
uaccaguuaaagcaaaa

SEQ ID NO: 2817 - RNA, 17 nt, Mus musculus
aaaagacuuucaaacac

SEQ ID NO: 2818 - RNA, 17 nt, Mus musculus
aaagacuuucaaacacg

SEQ ID NO: 2819 - RNA, 17 nt, Mus musculus
aagacuuucaaacacgu

SEQ ID NO: 2820 - RNA, 17 nt, Mus musculus
cguggacucuguccucc

SEQ ID NO: 2821 - RNA, 17 nt, Mus musculus
gacucuguccuccaaga

SEQ ID NO: 2822 - RNA, 17 nt, Mus musculus
ucuguccuccaagaagu

SEQ ID NO: 2823 - RNA, 17 nt, Mus musculus
cggcaccucugugaaac

SEQ ID NO: 2824 - RNA, 17 nt, Mus musculus
aacuggaucgaaugggc

SEQ ID NO: 2825 - RNA, 17 nt, Mus musculus
gcaaugcuuuguguguu

SEQ ID NO: 2826 - RNA, 17 nt, Mus musculus
caaugcuuuguguguug

SEQ ID NO: 2827 - RNA, 17 nt, Mus musculus
uuguguguugaggaugg

SEQ ID NO: 2828 - RNA, 17 nt, Mus musculus
ugagaugucccagggcc

SEQ ID NO: 2829 - RNA, 17 nt, Mus musculus
ggccgagucugucuacc

SEQ ID NO: 2830 - RNA, 17 nt, Mus musculus
gagucugucuaccuugg

SEQ ID NO: 2831 - RNA, 17 nt, Mus musculus
gucugucuaccuuggag

SEQ ID NO: 2832 - RNA, 17 nt, Mus musculus
gucuaccuuggaggcuu

SEQ ID NO: 2833 - RNA, 17 nt, Mus musculus
uggaggcuuuguggagg

SEQ ID NO: 2834 - RNA, 17 nt, Mus musculus
ggaggcuuuguggagga

SEQ ID NO: 2835 - RNA, 17 nt, Mus musculus
ugcgggcuaugagccaa

SEQ ID NO: 2836 - RNA, 17 nt, Mus musculus
ccaaguguuaagugugg

SEQ ID NO: 2837 - RNA, 17 nt, Mus musculus
caaguguuaaguguggg

SEQ ID NO: 2838 - RNA, 17 nt, Mus musculus
gcgcaagucgcucggag

SEQ ID NO: 2839 - RNA, 17 nt, Mus musculus
aagucgcucggagagcg

SEQ ID NO: 2840 - RNA, 17 nt, Mus musculus
agagcgguuggagccug

SEQ ID NO: 2841 - RNA, 17 nt, Mus musculus
agaugcauugugcuggc

SEQ ID NO: 2842 - RNA, 17 nt, Mus musculus
ugcuggcucugguggag

SEQ ID NO: 2843 - RNA, 17 nt, Mus musculus
ggugggcuuguggccug

SEQ ID NO: 2844 - RNA, 17 nt, Mus musculus
uggccugucaggaaacg

SEQ ID NO: 2845 - RNA, 17 nt, Mus musculus
ggcaggguuugguuuug

SEQ ID NO: 2846 - RNA, 17 nt, Mus musculus
gcaggguuugguuuugg

SEQ ID NO: 2847 - RNA, 17 nt, Mus musculus
gguuugguuuuggaagg

SEQ ID NO: 2848 - RNA, 17 nt, Mus musculus
guuugguuuuggaaggu

SEQ ID NO: 2849 - RNA, 17 nt, Mus musculus
uuugguuuuggaagguu

SEQ ID NO: 2850 - RNA, 17 nt, Mus musculus
uggaagguuugcgugcu

SEQ ID NO: 2851 - RNA, 17 nt, Mus musculus
ggaagguuugcgugcuc

SEQ ID NO: 2852 - RNA, 17 nt, Mus musculus
ugcgugcucuucacagu

SEQ ID NO: 2853 - RNA, 17 nt, Mus musculus
cgugcucuucacagucg

SEQ ID NO: 2854 - RNA, 17 nt, Mus musculus
gugcucuucacagucgg

SEQ ID NO: 2855 - RNA, 17 nt, Mus musculus
uucacagucggguuaca

SEQ ID NO: 2856 - RNA, 17 nt, Mus musculus
agucggguuacaggcga

SEQ ID NO: 2857 - RNA, 17 nt, Mus musculus
gucggguuacaggcgag

SEQ ID NO: 2858 - RNA, 17 nt, Mus musculus
aggcgaguucccugugg

SEQ ID NO: 2859 - RNA, 17 nt, Mus musculus
ggcgaguucccuguggc

SEQ ID NO: 2860 - RNA, 17 nt, Mus musculus
uguggcguuuccuacuc

SEQ ID NO: 2861 - RNA, 17 nt, Mus musculus
guggcguuuccuacucc

SEQ ID NO: 2862 - RNA, 17 nt, Mus musculus
uggcguuuccuacuccu

SEQ ID NO: 2863 - RNA, 17 nt, Mus musculus
cguuuccuacuccuaau

SEQ ID NO: 2864 - RNA, 17 nt, Mus musculus
uuccuacuccuaaugag

SEQ ID NO: 2865 - RNA, 17 nt, Mus musculus
cuacuccuaaugagagu

SEQ ID NO: 2866 - RNA, 17 nt, Mus musculus
augagaguuccuuccgg

SEQ ID NO: 2867 - RNA, 17 nt, Mus musculus
ugagaguuccuuccgga

SEQ ID NO: 2868 - RNA, 17 nt, Mus musculus
gaguuccuuccggacuc

SEQ ID NO: 2869 - RNA, 17 nt, Mus musculus
aguuccuuccggacucu

SEQ ID NO: 2870 - RNA, 17 nt, Mus musculus
uccggacucuuacgugu

SEQ ID NO: 2871 - RNA, 17 nt, Mus musculus
cggacucuuacgugucu

SEQ ID NO: 2872 - RNA, 17 nt, Mus musculus
ggacucuuacgugucuc

SEQ ID NO: 2873 - RNA, 17 nt, Mus musculus
uuacgugucuccuggcc

SEQ ID NO: 2874 - RNA, 17 nt, Mus musculus
acgugucuccuggccug

SEQ ID NO: 2875 - RNA, 17 nt, Mus musculus
augcagcuugcuccuuc

SEQ ID NO: 2876 - RNA, 17 nt, Mus musculus
agcuugcuccuuccuca

SEQ ID NO: 2877 - RNA, 17 nt, Mus musculus
uugcuccuuccucaucu

SEQ ID NO: 2878 - RNA, 17 nt, Mus musculus
ugcuccuuccucaucuc

SEQ ID NO: 2879 - RNA, 17 nt, Mus musculus
uccuuccucaucucuca

SEQ ID NO: 2880 - RNA, 17 nt, Mus musculus
uuccucaucucucaggc

SEQ ID NO: 2881 - RNA, 17 nt, Mus musculus
ccucaucucucaggcug

SEQ ID NO: 2882 - RNA, 17 nt, Mus musculus
ucaucucucaggcugug

SEQ ID NO: 2883 - RNA, 17 nt, Mus musculus
cugugccuuaauucaga

SEQ ID NO: 2884 - RNA, 17 nt, Mus musculus
ugugccuuaauucagaa

SEQ ID NO: 2885 - RNA, 17 nt, Mus musculus
gccuuaauucagaacac

SEQ ID NO: 2886 - RNA, 17 nt, Mus musculus
ccuuaauucagaacacc

SEQ ID NO: 2887 - RNA, 17 nt, Mus musculus
aggaacgucggcagagg

SEQ ID NO: 2888 - RNA, 17 nt, Mus musculus
cagaggcuccugacggg

SEQ ID NO: 2889 - RNA, 17 nt, Mus musculus
cgaagaauugugagaac

SEQ ID NO: 2890 - RNA, 17 nt, Mus musculus
cagaaacucaggguuuc

SEQ ID NO: 2891 - RNA, 17 nt, Mus musculus
cucaggguuucugcugg

SEQ ID NO: 2892 - RNA, 17 nt, Mus musculus
ucaggguuucugcuggg

SEQ ID NO: 2893 - RNA, 17 nt, Mus musculus
caggguuucugcugggu

SEQ ID NO: 2894 - RNA, 17 nt, Mus musculus
uggcaggucugaggguu

SEQ ID NO: 2895 - RNA, 17 nt, Mus musculus
cugaggguucucuguca

SEQ ID NO: 2896 - RNA, 17 nt, Mus musculus
ugaggguucucugucaa

SEQ ID NO: 2897 - RNA, 17 nt, Mus musculus
aggguucucugucaagu

SEQ ID NO: 2898 - RNA, 17 nt, Mus musculus
uucucugucaaguggcg

SEQ ID NO: 2899 - RNA, 17 nt, Mus musculus
guggcgguaaaggcuca

SEQ ID NO: 2900 - RNA, 17 nt, Mus musculus
uaaaggcucaggcuggu

SEQ ID NO: 2901 - RNA, 17 nt, Mus musculus
gcugguguucuuccucu

SEQ ID NO: 2902 - RNA, 17 nt, Mus musculus
cugguguucuuccucua

SEQ ID NO: 2903 - RNA, 17 nt, Mus musculus
gguguucuuccucuauc

SEQ ID NO: 2904 - RNA, 17 nt, Mus musculus
guguucuuccucuaucu

SEQ ID NO: 2905 - RNA, 17 nt, Mus musculus
uucuuccucuaucucca

SEQ ID NO: 2906 - RNA, 17 nt, Mus musculus
cuuccucuaucuccacu

SEQ ID NO: 2907 - RNA, 17 nt, Mus musculus
uccucuaucuccacucc

SEQ ID NO: 2908 - RNA, 17 nt, Mus musculus
cucuaucuccacuccug

SEQ ID NO: 2909 - RNA, 17 nt, Mus musculus
ucuccacuccugucagg

SEQ ID NO: 2910 - RNA, 17 nt, Mus musculus
acuccugucaggccccc

SEQ ID NO: 2911 - RNA, 17 nt, Mus musculus
ccccaaguccucaguau

SEQ ID NO: 2912 - RNA, 17 nt, Mus musculus
caaguccucaguauuuu

SEQ ID NO: 2913 - RNA, 17 nt, Mus musculus
uccucaguauuuuagcu

SEQ ID NO: 2914 - RNA, 17 nt, Mus musculus
cucaguauuuuagcuuu

SEQ ID NO: 2915 - RNA, 17 nt, Mus musculus
ucaguauuuuagcuuug

SEQ ID NO: 2916 - RNA, 17 nt, Mus musculus
caguauuuuagcuuugu

SEQ ID NO: 2917 - RNA, 17 nt, Mus musculus
aguauuuuagcuuugug

SEQ ID NO: 2918 - RNA, 17 nt, Mus musculus
uuuuagcuuuguggcuu

SEQ ID NO: 2919 - RNA, 17 nt, Mus musculus
uuuagcuuuguggcuuc

SEQ ID NO: 2920 - RNA, 17 nt, Mus musculus
uuguggcuuccugaugg

SEQ ID NO: 2921 - RNA, 17 nt, Mus musculus
uguggcuuccugauggc

SEQ ID NO: 2922 - RNA, 17 nt, Mus musculus
agaaaaaucuuaauugg

SEQ ID NO: 2923 - RNA, 17 nt, Mus musculus
aaaaaucuuaauugguu

SEQ ID NO: 2924 - RNA, 17 nt, Mus musculus
aaaaucuuaauugguug

SEQ ID NO: 2925 - RNA, 17 nt, Mus musculus
aucuuaauugguugguu

SEQ ID NO: 2926 - RNA, 17 nt, Mus musculus
uaauugguugguuugcu

SEQ ID NO: 2927 - RNA, 17 nt, Mus musculus
ugguugguuugcucucc

SEQ ID NO: 2928 - RNA, 17 nt, Mus musculus
gguugguuugcucucca

SEQ ID NO: 2929 - RNA, 17 nt, Mus musculus
gguuugcucuccagaua

SEQ ID NO: 2930 - RNA, 17 nt, Mus musculus
uuugcucuccagauaau

SEQ ID NO: 2931 - RNA, 17 nt, Mus musculus
cuccagauaaucacuag

SEQ ID NO: 2932 - RNA, 17 nt, Mus musculus
cagauaaucacuagcca

SEQ ID NO: 2933 - RNA, 17 nt, Mus musculus
uaaucacuagccagauu

SEQ ID NO: 2934 - RNA, 17 nt, Mus musculus
agccagauuucgaaauu

SEQ ID NO: 2935 - RNA, 17 nt, Mus musculus
gccagauuucgaaauua

SEQ ID NO: 2936 - RNA, 17 nt, Mus musculus
ccagauuucgaaauuac

SEQ ID NO: 2937 - RNA, 17 nt, Mus musculus
uucgaaauuacuuuuua

SEQ ID NO: 2938 - RNA, 17 nt, Mus musculus
ucgaaauuacuuuuuag

SEQ ID NO: 2939 - RNA, 17 nt, Mus musculus
aaauuacuuuuuagccg

SEQ ID NO: 2940 - RNA, 17 nt, Mus musculus
aauuacuuuuuagccga

SEQ ID NO: 2941 - RNA, 17 nt, Mus musculus
auuacuuuuuagccgag

SEQ ID NO: 2942 - RNA, 17 nt, Mus musculus
uuacuuuuuagccgagg

SEQ ID NO: 2943 - RNA, 17 nt, Mus musculus
uacuuuuuagccgaggu

SEQ ID NO: 2944 - RNA, 17 nt, Mus musculus
gccgagguuaugauaac

SEQ ID NO: 2945 - RNA, 17 nt, Mus musculus
ccgagguuaugauaaca

SEQ ID NO: 2946 - RNA, 17 nt, Mus musculus
guuaugauaacaucuac

SEQ ID NO: 2947 - RNA, 17 nt, Mus musculus
gauaacaucuacuguau

SEQ ID NO: 2948 - RNA, 17 nt, Mus musculus
uaacaucuacuguaucc

SEQ ID NO: 2949 - RNA, 17 nt, Mus musculus
ucuacuguauccuuuag

SEQ ID NO: 2950 - RNA, 17 nt, Mus musculus
uacuguauccuuuagaa

SEQ ID NO: 2951 - RNA, 17 nt, Mus musculus
uguauccuuuagaauuu

SEQ ID NO: 2952 - RNA, 17 nt, Mus musculus
guauccuuuagaauuuu

SEQ ID NO: 2953 - RNA, 17 nt, Mus musculus
uauccuuuagaauuuua

SEQ ID NO: 2954 - RNA, 17 nt, Mus musculus
uuuagaauuuuaaccua

SEQ ID NO: 2955 - RNA, 17 nt, Mus musculus
uuagaauuuuaaccuau

SEQ ID NO: 2956 - RNA, 17 nt, Mus musculus
uagaauuuuaaccuaua

SEQ ID NO: 2957 - RNA, 17 nt, Mus musculus
agaauuuuaaccuauaa

SEQ ID NO: 2958 - RNA, 17 nt, Mus musculus
uuuaaccuauaaaacua

SEQ ID NO: 2959 - RNA, 17 nt, Mus musculus
uaaccuauaaaacuaug

SEQ ID NO: 2960 - RNA, 17 nt, Mus musculus
auaaaacuaugucuacu

SEQ ID NO: 2961 - RNA, 17 nt, Mus musculus
aacuaugucuacugguu

SEQ ID NO: 2962 - RNA, 17 nt, Mus musculus
cuaugucuacugguuuc

SEQ ID NO: 2963 - RNA, 17 nt, Mus musculus
cuacugguuucugccug

SEQ ID NO: 2964 - RNA, 17 nt, Mus musculus
uacugguuucugccugu

SEQ ID NO: 2965 - RNA, 17 nt, Mus musculus
acugguuucugccugug

SEQ ID NO: 2966 - RNA, 18 nt, Mus musculus
gggcccagacuguguccc

SEQ ID NO: 2967 - RNA, 18 nt, Mus musculus
ucccgcagccgggauaac

SEQ ID NO: 2968 - RNA, 18 nt, Mus musculus
ccuggcugacccgauucc

SEQ ID NO: 2969 - RNA, 18 nt, Mus musculus
cugacccgauuccgcgga

SEQ ID NO: 2970 - RNA, 18 nt, Mus musculus
ggacaccgcugacagccg

SEQ ID NO: 2971 - RNA, 18 nt, Mus musculus
gcugacagccgcggcugg

SEQ ID NO: 2972 - RNA, 18 nt, Mus musculus
agccgcggcuggagccag

SEQ ID NO: 2973 - RNA, 18 nt, Mus musculus
cuccccggucuugcgcug

SEQ ID NO: 2974 - RNA, 18 nt, Mus musculus
ccauaccgccucugugac

SEQ ID NO: 2975 - RNA, 18 nt, Mus musculus
gcuagcugucgcucugug

SEQ ID NO: 2976 - RNA, 18 nt, Mus musculus
ccgagccgccucuguggg

SEQ ID NO: 2977 - RNA, 18 nt, Mus musculus
cccuucagauuacuugca

SEQ ID NO: 2978 - RNA, 18 nt, Mus musculus
cuccacuguuuaugucua

SEQ ID NO: 2979 - RNA, 18 nt, Mus musculus
gauuacagaucaccauuc

SEQ ID NO: 2980 - RNA, 18 nt, Mus musculus
auccccugccgagggucg

SEQ ID NO: 2981 - RNA, 18 nt, Mus musculus
uguuccggauggaaacag

SEQ ID NO: 2982 - RNA, 18 nt, Mus musculus
ccuaucagucuaucaugu

SEQ ID NO: 2983 - RNA, 18 nt, Mus musculus
gcuaucugccggagaaaa

SEQ ID NO: 2984 - RNA, 18 nt, Mus musculus
guggacggaugaucaaga

SEQ ID NO: 2985 - RNA, 18 nt, Mus musculus
uuacccagcuccugauau

SEQ ID NO: 2986 - RNA, 18 nt, Mus musculus
caccccagaucggugaga

SEQ ID NO: 2987 - RNA, 18 nt, Mus musculus
augcacagucuacgccaa

SEQ ID NO: 2988 - RNA, 18 nt, Mus musculus
gaagccugcuccuacaga

SEQ ID NO: 2989 - RNA, 18 nt, Mus musculus
uccuacagacccggccaa

SEQ ID NO: 2990 - RNA, 18 nt, Mus musculus
augcccugauugaaggaa

SEQ ID NO: 2991 - RNA, 18 nt, Mus musculus
gcaaccugcugcccagcc

SEQ ID NO: 2992 - RNA, 18 nt, Mus musculus
accugcugcccagccaac

SEQ ID NO: 2993 - RNA, 18 nt, Mus musculus
ugucccuguugugcacug

SEQ ID NO: 2994 - RNA, 18 nt, Mus musculus
aacaucgguccacauggg

SEQ ID NO: 2995 - RNA, 18 nt, Mus musculus
cacaccaguuugcaagaa

SEQ ID NO: 2996 - RNA, 18 nt, Mus musculus
uugcucugcucaagauaa

SEQ ID NO: 2997 - RNA, 18 nt, Mus musculus
ucaaacagcucaucaucc

SEQ ID NO: 2998 - RNA, 18 nt, Mus musculus
ggaaccugacuauccgca

SEQ ID NO: 2999 - RNA, 18 nt, Mus musculus
uccuacggaccguuaagc

SEQ ID NO: 3000 - RNA, 18 nt, Mus musculus
ggauccagaugaauugcc

SEQ ID NO: 3001 - RNA, 18 nt, Mus musculus
gggaccggcugaaacuag

SEQ ID NO: 3002 - RNA, 18 nt, Mus musculus
ugaggcagacgcuuuugg

SEQ ID NO: 3003 - RNA, 18 nt, Mus musculus
ucugccagcucaggcuuu

SEQ ID NO: 3004 - RNA, 18 nt, Mus musculus
gacuucggcuuggcccgg

SEQ ID NO: 3005 - RNA, 18 nt, Mus musculus
agacccggauuaugucag

SEQ ID NO: 3006 - RNA, 18 nt, Mus musculus
gaugcccgacucccuuug

SEQ ID NO: 3007 - RNA, 18 nt, Mus musculus
ggcuccugacuacacuac

SEQ ID NO: 3008 - RNA, 18 nt, Mus musculus
cuggacugcuggcaugag

SEQ ID NO: 3009 - RNA, 18 nt, Mus musculus
ucucccugccuaccucac

SEQ ID NO: 3010 - RNA, 18 nt, Mus musculus
gaucccagaugacagcca

SEQ ID NO: 3011 - RNA, 18 nt, Mus musculus
ccaaccagaccaguggcu

SEQ ID NO: 3012 - RNA, 18 nt, Mus musculus
gcuaccagucuggguauc

SEQ ID NO: 3013 - RNA, 18 nt, Mus musculus
ucacucagaugacacaga

SEQ ID NO: 3014 - RNA, 18 nt, Mus musculus
ugcugcaguucacgcuga

SEQ ID NO: 3015 - RNA, 18 nt, Mus musculus
ucacgcugacucagggac

SEQ ID NO: 3016 - RNA, 18 nt, Mus musculus
cacugcagcucaccuccu

SEQ ID NO: 3017 - RNA, 18 nt, Mus musculus
accuccuguuuaaaugga

SEQ ID NO: 3018 - RNA, 18 nt, Mus musculus
ugguccugucccggcucc

SEQ ID NO: 3019 - RNA, 18 nt, Mus musculus
ugucccggcuccgccccc

SEQ ID NO: 3020 - RNA, 18 nt, Mus musculus
cggcuccgcccccaacuc

SEQ ID NO: 3021 - RNA, 18 nt, Mus musculus
aggugcugcuuagauuuu

SEQ ID NO: 3022 - RNA, 18 nt, Mus musculus
gaccucagacugcaagga

SEQ ID NO: 3023 - RNA, 18 nt, Mus musculus
gugcccugcuguggucuc

SEQ ID NO: 3024 - RNA, 18 nt, Mus musculus
ggacucuguccuccaaga

SEQ ID NO: 3025 - RNA, 18 nt, Mus musculus
cgagucugucuaccuugg

SEQ ID NO: 3026 - RNA, 18 nt, Mus musculus
gagagcgguuggagccug

SEQ ID NO: 3027 - RNA, 18 nt, Mus musculus
gccugcagaugcauugug

SEQ ID NO: 3028 - RNA, 18 nt, Mus musculus
aaaggcggccggcagggu

SEQ ID NO: 3029 - RNA, 18 nt, Mus musculus
cuucacagucggguuaca

SEQ ID NO: 3030 - RNA, 18 nt, Mus musculus
ccuuccggacucuuacgu

SEQ ID NO: 3031 - RNA, 18 nt, Mus musculus
ugaugcagcuugcuccuu

SEQ ID NO: 3032 - RNA, 18 nt, Mus musculus
ggcuccugacggggccga

SEQ ID NO: 3033 - RNA, 18 nt, Mus musculus
gguuucugcuggguggag

SEQ ID NO: 3034 - RNA, 18 nt, Mus musculus
gcuuccugauggcagaaa

SEQ ID NO: 3035 - RNA, 18 nt, Mus musculus
cuagccagauuucgaaau

SEQ ID NO: 3036 - RNA, 18 nt, Mus musculus
gguuucugccugugugcu

SEQ ID NO: 3037 - RNA, 17 nt, Mus musculus
ggccgcgucuugcucac

SEQ ID NO: 3038 - RNA, 17 nt, Mus musculus
ccgcgucuugcucacca

SEQ ID NO: 3039 - RNA, 17 nt, Mus musculus
gucuugcucaccauggu

SEQ ID NO: 3040 - RNA, 17 nt, Mus musculus
accauggucagcugcug

SEQ ID NO: 3041 - RNA, 17 nt, Mus musculus
accgcggucuugccuua

SEQ ID NO: 3042 - RNA, 17 nt, Mus musculus
cgcggucuugccuuacg

SEQ ID NO: 3043 - RNA, 17 nt, Mus musculus
ucuugccuuacgcgcug

SEQ ID NO: 3044 - RNA, 17 nt, Mus musculus
cuugccuuacgcgcugc

SEQ ID NO: 3045 - RNA, 17 nt, Mus musculus
gcgcugcucgggugucu

SEQ ID NO: 3046 - RNA, 17 nt, Mus musculus
ucgggugucugcuucuc

SEQ ID NO: 3047 - RNA, 17 nt, Mus musculus
cugcuucucacaggaua

SEQ ID NO: 3048 - RNA, 17 nt, Mus musculus
cacaggauauggcucag

SEQ ID NO: 3049 - RNA, 17 nt, Mus musculus
auauggcucagggucga

SEQ ID NO: 3050 - RNA, 17 nt, Mus musculus
cucagggucgaaguuaa

SEQ ID NO: 3051 - RNA, 17 nt, Mus musculus
gucgaaguuaaaagugc

SEQ ID NO: 3052 - RNA, 17 nt, Mus musculus
ucgaaguuaaaagugcc

SEQ ID NO: 3053 - RNA, 17 nt, Mus musculus
cagcaugucaugcaagc

SEQ ID NO: 3054 - RNA, 17 nt, Mus musculus
gccagacucucuuucuc

SEQ ID NO: 3055 - RNA, 17 nt, Mus musculus
cagacucucuuucucaa

SEQ ID NO: 3056 - RNA, 17 nt, Mus musculus
gacucucuuucucaagu

SEQ ID NO: 3057 - RNA, 17 nt, Mus musculus
acucucuuucucaagug

SEQ ID NO: 3058 - RNA, 17 nt, Mus musculus
cucucuuucucaagugc

SEQ ID NO: 3059 - RNA, 17 nt, Mus musculus
cucuuucucaagugcag

SEQ ID NO: 3060 - RNA, 17 nt, Mus musculus
agcccacucauggucuc

SEQ ID NO: 3061 - RNA, 17 nt, Mus musculus
cucauggucucugccca

SEQ ID NO: 3062 - RNA, 17 nt, Mus musculus
cauggucucugcccacg

SEQ ID NO: 3063 - RNA, 17 nt, Mus musculus
cugagcaucacuccccc

SEQ ID NO: 3064 - RNA, 17 nt, Mus musculus
gcaucacucccccaucg

SEQ ID NO: 3065 - RNA, 17 nt, Mus musculus
ucccccaucggccugug

SEQ ID NO: 3066 - RNA, 17 nt, Mus musculus
ggagggauaacaggcaa

SEQ ID NO: 3067 - RNA, 17 nt, Mus musculus
caggcaauucugcagca

SEQ ID NO: 3068 - RNA, 17 nt, Mus musculus
aggcaauucugcagcac

SEQ ID NO: 3069 - RNA, 17 nt, Mus musculus
cagcaccuugaccuugg

SEQ ID NO: 3070 - RNA, 17 nt, Mus musculus
cuugaccuuggacacgg

SEQ ID NO: 3071 - RNA, 17 nt, Mus musculus
acgggccucuacaccug

SEQ ID NO: 3072 - RNA, 17 nt, Mus musculus
gggccucuacaccugua

SEQ ID NO: 3073 - RNA, 17 nt, Mus musculus
acaccuguagauaccuc

SEQ ID NO: 3074 - RNA, 17 nt, Mus musculus
cuguagauaccucccua

SEQ ID NO: 3075 - RNA, 17 nt, Mus musculus
agauaccucccuacauc

SEQ ID NO: 3076 - RNA, 17 nt, Mus musculus
accucccuacaucuacu

SEQ ID NO: 3077 - RNA, 17 nt, Mus musculus
cccuacaucuacuucga

SEQ ID NO: 3078 - RNA, 17 nt, Mus musculus
cuacaucuacuucgaag

SEQ ID NO: 3079 - RNA, 17 nt, Mus musculus
caucuacuucgaagaaa

SEQ ID NO: 3080 - RNA, 17 nt, Mus musculus
aucuacuucgaagaaaa

SEQ ID NO: 3081 - RNA, 17 nt, Mus musculus
agcggaaucuucaaucu

SEQ ID NO: 3082 - RNA, 17 nt, Mus musculus
cggaaucuucaaucuac

SEQ ID NO: 3083 - RNA, 17 nt, Mus musculus
ggaaucuucaaucuaca

SEQ ID NO: 3084 - RNA, 17 nt, Mus musculus
ucuucaaucuacauauu

SEQ ID NO: 3085 - RNA, 17 nt, Mus musculus
uucaaucuacauauuug

SEQ ID NO: 3086 - RNA, 17 nt, Mus musculus
aucuacauauuuguuag

SEQ ID NO: 3087 - RNA, 17 nt, Mus musculus
cuacauauuuguuagug

SEQ ID NO: 3088 - RNA, 17 nt, Mus musculus
uacauauuuguuaguga

SEQ ID NO: 3089 - RNA, 17 nt, Mus musculus
auauuuguuagugaugc

SEQ ID NO: 3090 - RNA, 17 nt, Mus musculus
uauuuguuagugaugca

SEQ ID NO: 3091 - RNA, 17 nt, Mus musculus
cagggaguccuuucaua

SEQ ID NO: 3092 - RNA, 17 nt, Mus musculus
ggaguccuuucauagag

SEQ ID NO: 3093 - RNA, 17 nt, Mus musculus
gaguccuuucauagaga

SEQ ID NO: 3094 - RNA, 17 nt, Mus musculus
aguccuuucauagagau

SEQ ID NO: 3095 - RNA, 17 nt, Mus musculus
ccuuucauagagaugca

SEQ ID NO: 3096 - RNA, 17 nt, Mus musculus
acugacauacccaaacu

SEQ ID NO: 3097 - RNA, 17 nt, Mus musculus
cccaaacuugugcacau

SEQ ID NO: 3098 - RNA, 17 nt, Mus musculus
agacagcucaucauccc

SEQ ID NO: 3099 - RNA, 17 nt, Mus musculus
cagcucaucauccccug

SEQ ID NO: 3100 - RNA, 17 nt, Mus musculus
cucaucauccccugccg

SEQ ID NO: 3101 - RNA, 17 nt, Mus musculus
ggugacgucacccaacg

SEQ ID NO: 3102 - RNA, 17 nt, Mus musculus
cccaacgucacagucac

SEQ ID NO: 3103 - RNA, 17 nt, Mus musculus
gucacagucacccuaaa

SEQ ID NO: 3104 - RNA, 17 nt, Mus musculus
gucacccuaaaaaaguu

SEQ ID NO: 3105 - RNA, 17 nt, Mus musculus
aaaaaaguuuccauuug

SEQ ID NO: 3106 - RNA, 17 nt, Mus musculus
aaaaaguuuccauuuga

SEQ ID NO: 3107 - RNA, 17 nt, Mus musculus
aaaaguuuccauuugau

SEQ ID NO: 3108 - RNA, 17 nt, Mus musculus
guuuccauuugauacuc

SEQ ID NO: 3109 - RNA, 17 nt, Mus musculus
uuuccauuugauacucu

SEQ ID NO: 3110 - RNA, 17 nt, Mus musculus
cauuugauacucuuacc

SEQ ID NO: 3111 - RNA, 17 nt, Mus musculus
uugauacucuuaccccu

SEQ ID NO: 3112 - RNA, 17 nt, Mus musculus
gauacucuuaccccuga

SEQ ID NO: 3113 - RNA, 17 nt, Mus musculus
auacucuuaccccugau

SEQ ID NO: 3114 - RNA, 17 nt, Mus musculus
caaagaauaacauggga

SEQ ID NO: 3115 - RNA, 17 nt, Mus musculus
gggacaguaggagaggc

SEQ ID NO: 3116 - RNA, 17 nt, Mus musculus
gagaggcuuuauaauag

SEQ ID NO: 3117 - RNA, 17 nt, Mus musculus
agaggcuuuauaauagc

SEQ ID NO: 3118 - RNA, 17 nt, Mus musculus
gaggcuuuauaauagca

SEQ ID NO: 3119 - RNA, 17 nt, Mus musculus
ggcuuuauaauagcaaa

SEQ ID NO: 3120 - RNA, 17 nt, Mus musculus
uuuauaauagcaaaugc

SEQ ID NO: 3121 - RNA, 17 nt, Mus musculus
ugcaacguacaaagaga

SEQ ID NO: 3122 - RNA, 17 nt, Mus musculus
aaagagauaggacugcu

SEQ ID NO: 3123 - RNA, 17 nt, Mus musculus
gccaccgucaacgggca

SEQ ID NO: 3124 - RNA, 17 nt, Mus musculus
gcaccuguaccagacaa

SEQ ID NO: 3125 - RNA, 17 nt, Mus musculus
gacaaacuaucugaccc

SEQ ID NO: 3126 - RNA, 17 nt, Mus musculus
caaacuaucugacccau

SEQ ID NO: 3127 - RNA, 17 nt, Mus musculus
ugacccaucggcagacc

SEQ ID NO: 3128 - RNA, 17 nt, Mus musculus
agaccaauacaauccua

SEQ ID NO: 3129 - RNA, 17 nt, Mus musculus
aauacaauccuagaugu

SEQ ID NO: 3130 - RNA, 17 nt, Mus musculus
acaauccuagaugucca

SEQ ID NO: 3131 - RNA, 17 nt, Mus musculus
cuagauguccaaauacg

SEQ ID NO: 3132 - RNA, 17 nt, Mus musculus
guccaaauacgcccgcc

SEQ ID NO: 3133 - RNA, 17 nt, Mus musculus
agacugcuccacgggca

SEQ ID NO: 3134 - RNA, 17 nt, Mus musculus
ggcagacucuuguccuc

SEQ ID NO: 3135 - RNA, 17 nt, Mus musculus
cagacucuuguccucaa

SEQ ID NO: 3136 - RNA, 17 nt, Mus musculus
acucuuguccucaacug

SEQ ID NO: 3137 - RNA, 17 nt, Mus musculus
cuuguccucaacugcac

SEQ ID NO: 3138 - RNA, 17 nt, Mus musculus
acggagcucaauacgag

SEQ ID NO: 3139 - RNA, 17 nt, Mus musculus
agcucaauacgagggug

SEQ ID NO: 3140 - RNA, 17 nt, Mus musculus
gcuggaauuacccuggu

SEQ ID NO: 3141 - RNA, 17 nt, Mus musculus
cuggaauuacccuggua

SEQ ID NO: 3142 - RNA, 17 nt, Mus musculus
acccugguaaagcaacu

SEQ ID NO: 3143 - RNA, 17 nt, Mus musculus
aagcaacuaagagagca

SEQ ID NO: 3144 - RNA, 17 nt, Mus musculus
gagagcaucuauaaggc

SEQ ID NO: 3145 - RNA, 17 nt, Mus musculus
gagcaucuauaaggcag

SEQ ID NO: 3146 - RNA, 17 nt, Mus musculus
gcaucuauaaggcagcg

SEQ ID NO: 3147 - RNA, 17 nt, Mus musculus
cagcggauugaccggag

SEQ ID NO: 3148 - RNA, 17 nt, Mus musculus
ggagccauucccacaac

SEQ ID NO: 3149 - RNA, 17 nt, Mus musculus
gagccauucccacaaca

SEQ ID NO: 3150 - RNA, 17 nt, Mus musculus
caauguguuccacagug

SEQ ID NO: 3151 - RNA, 17 nt, Mus musculus
aauguguuccacagugu

SEQ ID NO: 3152 - RNA, 17 nt, Mus musculus
cacaguguucuuaagau

SEQ ID NO: 3153 - RNA, 17 nt, Mus musculus
acaguguucuuaagauc

SEQ ID NO: 3154 - RNA, 17 nt, Mus musculus
aguguucuuaagaucaa

SEQ ID NO: 3155 - RNA, 17 nt, Mus musculus
guguucuuaagaucaac

SEQ ID NO: 3156 - RNA, 17 nt, Mus musculus
cuuaagaucaacaaugu

SEQ ID NO: 3157 - RNA, 17 nt, Mus musculus
aaggggcucuacaccug

SEQ ID NO: 3158 - RNA, 17 nt, Mus musculus
ggggcucuacaccuguc

SEQ ID NO: 3159 - RNA, 17 nt, Mus musculus
acaccugucgcgugaag

SEQ ID NO: 3160 - RNA, 17 nt, Mus musculus
gaguggguccucguucc

SEQ ID NO: 3161 - RNA, 17 nt, Mus musculus
uggguccucguuccagu

SEQ ID NO: 3162 - RNA, 17 nt, Mus musculus
guccucguuccagucuu

SEQ ID NO: 3163 - RNA, 17 nt, Mus musculus
uccucguuccagucuuu

SEQ ID NO: 3164 - RNA, 17 nt, Mus musculus
guuccagucuuucaaca

SEQ ID NO: 3165 - RNA, 17 nt, Mus musculus
uccagucuuucaacacc

SEQ ID NO: 3166 - RNA, 17 nt, Mus musculus
ccagucuuucaacaccu

SEQ ID NO: 3167 - RNA, 17 nt, Mus musculus
cagucuuucaacaccuc

SEQ ID NO: 3168 - RNA, 17 nt, Mus musculus
caacaccuccgugcaug

SEQ ID NO: 3169 - RNA, 17 nt, Mus musculus
gcauguguaugaaaaag

SEQ ID NO: 3170 - RNA, 17 nt, Mus musculus
aaaaggauucaucagug

SEQ ID NO: 3171 - RNA, 17 nt, Mus musculus
aaaggauucaucagugu

SEQ ID NO: 3172 - RNA, 17 nt, Mus musculus
ggauucaucagugugaa

SEQ ID NO: 3173 - RNA, 17 nt, Mus musculus
ugaaacaucggaagcag

SEQ ID NO: 3174 - RNA, 17 nt, Mus musculus
aagacgguccuaucggc

SEQ ID NO: 3175 - RNA, 17 nt, Mus musculus
acgguccuaucggcugu

SEQ ID NO: 3176 - RNA, 17 nt, Mus musculus
gguccuaucggcugucc

SEQ ID NO: 3177 - RNA, 17 nt, Mus musculus
ucggcuguccaugaaag

SEQ ID NO: 3178 - RNA, 17 nt, Mus musculus
gaaggccuuccccuccc

SEQ ID NO: 3179 - RNA, 17 nt, Mus musculus
aaggccuuccccucccc

SEQ ID NO: 3180 - RNA, 17 nt, Mus musculus
cuuccccuccccagaaa

SEQ ID NO: 3181 - RNA, 17 nt, Mus musculus
ccagaaaucguaugguu

SEQ ID NO: 3182 - RNA, 17 nt, Mus musculus
gaaaucguaugguuaaa

SEQ ID NO: 3183 - RNA, 17 nt, Mus musculus
cguaugguuaaaagaug

SEQ ID NO: 3184 - RNA, 17 nt, Mus musculus
agauggcucgccugcaa

SEQ ID NO: 3185 - RNA, 17 nt, Mus musculus
ugcaacauugaagucug

SEQ ID NO: 3186 - RNA, 17 nt, Mus musculus
auugaagucugcucgcu

SEQ ID NO: 3187 - RNA, 17 nt, Mus musculus
agucugcucgcuauuug

SEQ ID NO: 3188 - RNA, 17 nt, Mus musculus
ugcucgcuauuugguac

SEQ ID NO: 3189 - RNA, 17 nt, Mus musculus
cucgcuauuugguacau

SEQ ID NO: 3190 - RNA, 17 nt, Mus musculus
ucgcuauuugguacaug

SEQ ID NO: 3191 - RNA, 17 nt, Mus musculus
uauuugguacauggcua

SEQ ID NO: 3192 - RNA, 17 nt, Mus musculus
acauggcuacucauuaa

SEQ ID NO: 3193 - RNA, 17 nt, Mus musculus
uggcuacucauuaauua

SEQ ID NO: 3194 - RNA, 17 nt, Mus musculus
cuacucauuaauuauca

SEQ ID NO: 3195 - RNA, 17 nt, Mus musculus
uacucauuaauuaucaa

SEQ ID NO: 3196 - RNA, 17 nt, Mus musculus
ucauuaauuaucaaaga

SEQ ID NO: 3197 - RNA, 17 nt, Mus musculus
cauuaauuaucaaagau

SEQ ID NO: 3198 - RNA, 17 nt, Mus musculus
uuaauuaucaaagaugu

SEQ ID NO: 3199 - RNA, 17 nt, Mus musculus
aggggacuauacgaucu

SEQ ID NO: 3200 - RNA, 17 nt, Mus musculus
gggacuauacgaucuug

SEQ ID NO: 3201 - RNA, 17 nt, Mus musculus
uauacgaucuugcuggg

SEQ ID NO: 3202 - RNA, 17 nt, Mus musculus
uacgaucuugcugggca

SEQ ID NO: 3203 - RNA, 17 nt, Mus musculus
cugggcauaaagcaguc

SEQ ID NO: 3204 - RNA, 17 nt, Mus musculus
aaagcagucaaggcuau

SEQ ID NO: 3205 - RNA, 17 nt, Mus musculus
ucaaggcuauuuaaaaa

SEQ ID NO: 3206 - RNA, 17 nt, Mus musculus
aaggcuauuuaaaaacc

SEQ ID NO: 3207 - RNA, 17 nt, Mus musculus
aggcuauuuaaaaaccu

SEQ ID NO: 3208 - RNA, 17 nt, Mus musculus
ggcuauuuaaaaaccuc

SEQ ID NO: 3209 - RNA, 17 nt, Mus musculus
cugccacucucauugua

SEQ ID NO: 3210 - RNA, 17 nt, Mus musculus
gccacucucauuguaaa

SEQ ID NO: 3211 - RNA, 17 nt, Mus musculus
acucucauuguaaacgu

SEQ ID NO: 3212 - RNA, 17 nt, Mus musculus
cucauuguaaacgugaa

SEQ ID NO: 3213 - RNA, 17 nt, Mus musculus
ugaaaccucagaucuac

SEQ ID NO: 3214 - RNA, 17 nt, Mus musculus
ccucagaucuacgaaaa

SEQ ID NO: 3215 - RNA, 17 nt, Mus musculus
ucagaucuacgaaaagu

SEQ ID NO: 3216 - RNA, 17 nt, Mus musculus
cgaaaaguccguguccu

SEQ ID NO: 3217 - RNA, 17 nt, Mus musculus
guccguguccucgcuuc

SEQ ID NO: 3218 - RNA, 17 nt, Mus musculus
cguguccucgcuuccaa

SEQ ID NO: 3219 - RNA, 17 nt, Mus musculus
uccucgcuuccaagccc

SEQ ID NO: 3220 - RNA, 17 nt, Mus musculus
ccucgcuuccaagccca

SEQ ID NO: 3221 - RNA, 17 nt, Mus musculus
gcccaccucucuauccg

SEQ ID NO: 3222 - RNA, 17 nt, Mus musculus
ccaccucucuauccgcu

SEQ ID NO: 3223 - RNA, 17 nt, Mus musculus
accucucuauccgcugg

SEQ ID NO: 3224 - RNA, 17 nt, Mus musculus
cucucuauccgcugggc

SEQ ID NO: 3225 - RNA, 17 nt, Mus musculus
agacaaguccucacuug

SEQ ID NO: 3226 - RNA, 17 nt, Mus musculus
caaguccucacuugcac

SEQ ID NO: 3227 - RNA, 17 nt, Mus musculus
uccucacuugcaccgug

SEQ ID NO: 3228 - RNA, 17 nt, Mus musculus
caccguguauggcaucc

SEQ ID NO: 3229 - RNA, 17 nt, Mus musculus
uauggcaucccucggcc

SEQ ID NO: 3230 - RNA, 17 nt, Mus musculus
gcaucccucggccaaca

SEQ ID NO: 3231 - RNA, 17 nt, Mus musculus
ccaacaaucacguggcu

SEQ ID NO: 3232 - RNA, 17 nt, Mus musculus
acguggcucuggcaccc

SEQ ID NO: 3233 - RNA, 17 nt, Mus musculus
accccugucaccacaau

SEQ ID NO: 3234 - RNA, 17 nt, Mus musculus
accacaaucacuccaaa

SEQ ID NO: 3235 - RNA, 17 nt, Mus musculus
caaucacuccaaagaaa

SEQ ID NO: 3236 - RNA, 17 nt, Mus musculus
agaaagguaugacuucu

SEQ ID NO: 3237 - RNA, 17 nt, Mus musculus
guaugacuucugcacug

SEQ ID NO: 3238 - RNA, 17 nt, Mus musculus
uaugacuucugcacuga

SEQ ID NO: 3239 - RNA, 17 nt, Mus musculus
ugaagaauccuuuaucc

SEQ ID NO: 3240 - RNA, 17 nt, Mus musculus
agaauccuuuauccugg

SEQ ID NO: 3241 - RNA, 17 nt, Mus musculus
gaauccuuuauccugga

SEQ ID NO: 3242 - RNA, 17 nt, Mus musculus
aauccuuuauccuggau

SEQ ID NO: 3243 - RNA, 17 nt, Mus musculus
uccuuuauccuggaucc

SEQ ID NO: 3244 - RNA, 17 nt, Mus musculus
uccuggaucccagcagc

SEQ ID NO: 3245 - RNA, 17 nt, Mus musculus
cagcaacuuaggaaaca

SEQ ID NO: 3246 - RNA, 17 nt, Mus musculus
agcaacuuaggaaacag

SEQ ID NO: 3247 - RNA, 17 nt, Mus musculus
gagagcaucucucagcg

SEQ ID NO: 3248 - RNA, 17 nt, Mus musculus
gagcaucucucagcgca

SEQ ID NO: 3249 - RNA, 17 nt, Mus musculus
gcaucucucagcgcaug

SEQ ID NO: 3250 - RNA, 17 nt, Mus musculus
augacggucauagaagg

SEQ ID NO: 3251 - RNA, 17 nt, Mus musculus
acggucauagaaggaac

SEQ ID NO: 3252 - RNA, 17 nt, Mus musculus
gaacaaauaagacgguu

SEQ ID NO: 3253 - RNA, 17 nt, Mus musculus
aagacgguuagcacauu

SEQ ID NO: 3254 - RNA, 17 nt, Mus musculus
agacgguuagcacauug

SEQ ID NO: 3255 - RNA, 17 nt, Mus musculus
uagcacauugguggugg

SEQ ID NO: 3256 - RNA, 17 nt, Mus musculus
ggcugacucucagaccc

SEQ ID NO: 3257 - RNA, 17 nt, Mus musculus
cugacucucagaccccu

SEQ ID NO: 3258 - RNA, 17 nt, Mus musculus
ccuggaaucuacagcug

SEQ ID NO: 3259 - RNA, 17 nt, Mus musculus
uggaaucuacagcugcc

SEQ ID NO: 3260 - RNA, 17 nt, Mus musculus
ccgggccuucaauaaaa

SEQ ID NO: 3261 - RNA, 17 nt, Mus musculus
cgggccuucaauaaaau

SEQ ID NO: 3262 - RNA, 17 nt, Mus musculus
ccuucaauaaaauaggg

SEQ ID NO: 3263 - RNA, 17 nt, Mus musculus
aauaaaauagggacugu

SEQ ID NO: 3264 - RNA, 17 nt, Mus musculus
agaaacauaaaauuuua

SEQ ID NO: 3265 - RNA, 17 nt, Mus musculus
cauaaaauuuuauguca

SEQ ID NO: 3266 - RNA, 17 nt, Mus musculus
auaaaauuuuaugucac

SEQ ID NO: 3267 - RNA, 17 nt, Mus musculus
uaaaauuuuaugucaca

SEQ ID NO: 3268 - RNA, 17 nt, Mus musculus
aaaauuuuaugucacag

SEQ ID NO: 3269 - RNA, 17 nt, Mus musculus
uuuuaugucacagaugu

SEQ ID NO: 3270 - RNA, 17 nt, Mus musculus
gaauggcuuucacguuu

SEQ ID NO: 3271 - RNA, 17 nt, Mus musculus
aauggcuuucacguuuc

SEQ ID NO: 3272 - RNA, 17 nt, Mus musculus
auggcuuucacguuucc

SEQ ID NO: 3273 - RNA, 17 nt, Mus musculus
uuucacguuuccuugga

SEQ ID NO: 3274 - RNA, 17 nt, Mus musculus
uucacguuuccuuggaa

SEQ ID NO: 3275 - RNA, 17 nt, Mus musculus
ucacguuuccuuggaaa

SEQ ID NO: 3276 - RNA, 17 nt, Mus musculus
cguuuccuuggaaaaga

SEQ ID NO: 3277 - RNA, 17 nt, Mus musculus
gaaacuguccugugugg

SEQ ID NO: 3278 - RNA, 17 nt, Mus musculus
uguguggucaauaaauu

SEQ ID NO: 3279 - RNA, 17 nt, Mus musculus
uggucaauaaauuccug

SEQ ID NO: 3280 - RNA, 17 nt, Mus musculus
caauaaauuccuguaca

SEQ ID NO: 3281 - RNA, 17 nt, Mus musculus
aauaaauuccuguacag

SEQ ID NO: 3282 - RNA, 17 nt, Mus musculus
auuccuguacagagaca

SEQ ID NO: 3283 - RNA, 17 nt, Mus musculus
agagacauuaccuggau

SEQ ID NO: 3284 - RNA, 17 nt, Mus musculus
gagacauuaccuggauu

SEQ ID NO: 3285 - RNA, 17 nt, Mus musculus
accuggauucugcuacg

SEQ ID NO: 3286 - RNA, 17 nt, Mus musculus
ccuggauucugcuacgg

SEQ ID NO: 3287 - RNA, 17 nt, Mus musculus
auucugcuacggacagu

SEQ ID NO: 3288 - RNA, 17 nt, Mus musculus
cggacaguuaacaacag

SEQ ID NO: 3289 - RNA, 17 nt, Mus musculus
ggacaguuaacaacaga

SEQ ID NO: 3290 - RNA, 17 nt, Mus musculus
ugcaccauaguaucagc

SEQ ID NO: 3291 - RNA, 17 nt, Mus musculus
accauaguaucagcaag

SEQ ID NO: 3292 - RNA, 17 nt, Mus musculus
cauaguaucagcaagca

SEQ ID NO: 3293 - RNA, 17 nt, Mus musculus
ccaccacucaagauuac

SEQ ID NO: 3294 - RNA, 17 nt, Mus musculus
cucaagauuacuccauc

SEQ ID NO: 3295 - RNA, 17 nt, Mus musculus
ucaagauuacuccauca

SEQ ID NO: 3296 - RNA, 17 nt, Mus musculus
agauuacuccaucacuc

SEQ ID NO: 3297 - RNA, 17 nt, Mus musculus
uacuccaucacucugaa

SEQ ID NO: 3298 - RNA, 17 nt, Mus musculus
ccaucacucugaaccuu

SEQ ID NO: 3299 - RNA, 17 nt, Mus musculus
cugaaccuugucaucaa

SEQ ID NO: 3300 - RNA, 17 nt, Mus musculus
aaccuugucaucaagaa

SEQ ID NO: 3301 - RNA, 17 nt, Mus musculus
cuugucaucaagaacgu

SEQ ID NO: 3302 - RNA, 17 nt, Mus musculus
gaacgugucucuagaag

SEQ ID NO: 3303 - RNA, 17 nt, Mus musculus
acgugucucuagaagac

SEQ ID NO: 3304 - RNA, 17 nt, Mus musculus
gugucucuagaagacuc

SEQ ID NO: 3305 - RNA, 17 nt, Mus musculus
agaagacucgggcaccu

SEQ ID NO: 3306 - RNA, 17 nt, Mus musculus
gggcaccuaugcgugca

SEQ ID NO: 3307 - RNA, 17 nt, Mus musculus
aggaacauauacacagg

SEQ ID NO: 3308 - RNA, 17 nt, Mus musculus
gaacauauacacagggg

SEQ ID NO: 3309 - RNA, 17 nt, Mus musculus
gaagacauccuucggaa

SEQ ID NO: 3310 - RNA, 17 nt, Mus musculus
gacauccuucggaagac

SEQ ID NO: 3311 - RNA, 17 nt, Mus musculus
acauccuucggaagaca

SEQ ID NO: 3312 - RNA, 17 nt, Mus musculus
acagaaguucucguuag

SEQ ID NO: 3313 - RNA, 17 nt, Mus musculus
cagaaguucucguuaga

SEQ ID NO: 3314 - RNA, 17 nt, Mus musculus
gaaguucucguuagaga

SEQ ID NO: 3315 - RNA, 17 nt, Mus musculus
guucucguuagagauuc

SEQ ID NO: 3316 - RNA, 17 nt, Mus musculus
uucucguuagagauucg

SEQ ID NO: 3317 - RNA, 17 nt, Mus musculus
uuagagauucggaagcg

SEQ ID NO: 3318 - RNA, 17 nt, Mus musculus
uagagauucggaagcgc

SEQ ID NO: 3319 - RNA, 17 nt, Mus musculus
caccugcuucaaaaccu

SEQ ID NO: 3320 - RNA, 17 nt, Mus musculus
accugcuucaaaaccuc

SEQ ID NO: 3321 - RNA, 17 nt, Mus musculus
caaaaccucagugacua

SEQ ID NO: 3322 - RNA, 17 nt, Mus musculus
cagugacuacgaggucu

SEQ ID NO: 3323 - RNA, 17 nt, Mus musculus
uacgaggucuccaucag

SEQ ID NO: 3324 - RNA, 17 nt, Mus musculus
cgaggucuccaucagug

SEQ ID NO: 3325 - RNA, 17 nt, Mus musculus
gucuccaucaguggcuc

SEQ ID NO: 3326 - RNA, 17 nt, Mus musculus
caguggcucuacgaccu

SEQ ID NO: 3327 - RNA, 17 nt, Mus musculus
guggcucuacgaccuua

SEQ ID NO: 3328 - RNA, 17 nt, Mus musculus
uacgaccuuagacuguc

SEQ ID NO: 3329 - RNA, 17 nt, Mus musculus
acgaccuuagacuguca

SEQ ID NO: 3330 - RNA, 17 nt, Mus musculus
uagacugucaagcuaga

SEQ ID NO: 3331 - RNA, 17 nt, Mus musculus
gucaagcuagagguguc

SEQ ID NO: 3332 - RNA, 17 nt, Mus musculus
agagguguccccgcgcc

SEQ ID NO: 3333 - RNA, 17 nt, Mus musculus
ccgcgccucagaucacu

SEQ ID NO: 3334 - RNA, 17 nt, Mus musculus
agaucacuugguucaaa

SEQ ID NO: 3335 - RNA, 17 nt, Mus musculus
cacuugguucaaaaaca

SEQ ID NO: 3336 - RNA, 17 nt, Mus musculus
acuugguucaaaaacaa

SEQ ID NO: 3337 - RNA, 17 nt, Mus musculus
ccgggaauuauuuuagg

SEQ ID NO: 3338 - RNA, 17 nt, Mus musculus
cgggaauuauuuuagga

SEQ ID NO: 3339 - RNA, 17 nt, Mus musculus
gaaagagucacagagga

SEQ ID NO: 3340 - RNA, 17 nt, Mus musculus
gagggugucuauaggug

SEQ ID NO: 3341 - RNA, 17 nt, Mus musculus
gggugucuauaggugcc

SEQ ID NO: 3342 - RNA, 17 nt, Mus musculus
gugucuauaggugccga

SEQ ID NO: 3343 - RNA, 17 nt, Mus musculus
cgcagccuaccucaccg

SEQ ID NO: 3344 - RNA, 17 nt, Mus musculus
gccuaccucaccgugca

SEQ ID NO: 3345 - RNA, 17 nt, Mus musculus
aggaaccucagacaagu

SEQ ID NO: 3346 - RNA, 17 nt, Mus musculus
agacaagucaaaccugg

SEQ ID NO: 3347 - RNA, 17 nt, Mus musculus
gagcugaucacgcucac

SEQ ID NO: 3348 - RNA, 17 nt, Mus musculus
aucacgcucacgugcac

SEQ ID NO: 3349 - RNA, 17 nt, Mus musculus
gcgacccucuuuuggcu

SEQ ID NO: 3350 - RNA, 17 nt, Mus musculus
gacccucuuuuggcucc

SEQ ID NO: 3351 - RNA, 17 nt, Mus musculus
acccucuuuuggcuccu

SEQ ID NO: 3352 - RNA, 17 nt, Mus musculus
cccucuuuuggcuccuu

SEQ ID NO: 3353 - RNA, 17 nt, Mus musculus
uuuuggcuccuucuaac

SEQ ID NO: 3354 - RNA, 17 nt, Mus musculus
uggcuccuucuaacucu

SEQ ID NO: 3355 - RNA, 17 nt, Mus musculus
ggcuccuucuaacucuc

SEQ ID NO: 3356 - RNA, 17 nt, Mus musculus
cuccuucuaacucucuu

SEQ ID NO: 3357 - RNA, 17 nt, Mus musculus
uucuaacucucuucauc

SEQ ID NO: 3358 - RNA, 17 nt, Mus musculus
cuaacucucuucaucag

SEQ ID NO: 3359 - RNA, 17 nt, Mus musculus
aacucucuucaucagaa

SEQ ID NO: 3360 - RNA, 17 nt, Mus musculus
acucucuucaucagaaa

SEQ ID NO: 3361 - RNA, 17 nt, Mus musculus
cucuucaucagaaaacu

SEQ ID NO: 3362 - RNA, 17 nt, Mus musculus
gaagcggucuucuuccg

SEQ ID NO: 3363 - RNA, 17 nt, Mus musculus
agcggucuucuuccgaa

SEQ ID NO: 3364 - RNA, 17 nt, Mus musculus
gcggucuucuuccgaag

SEQ ID NO: 3365 - RNA, 17 nt, Mus musculus
ggucuucuuccgaagua

SEQ ID NO: 3366 - RNA, 17 nt, Mus musculus
gucuucuuccgaaguaa

SEQ ID NO: 3367 - RNA, 17 nt, Mus musculus
uccgaaguaaagacaga

SEQ ID NO: 3368 - RNA, 17 nt, Mus musculus
gacagacuaccugucaa

SEQ ID NO: 3369 - RNA, 17 nt, Mus musculus
cuaccugucaaucauua

SEQ ID NO: 3370 - RNA, 17 nt, Mus musculus
cugucaaucauuaugga

SEQ ID NO: 3371 - RNA, 17 nt, Mus musculus
ucaaucauuauggaccc

SEQ ID NO: 3372 - RNA, 17 nt, Mus musculus
caaucauuauggaccca

SEQ ID NO: 3373 - RNA, 17 nt, Mus musculus
gaugaaguuccccugga

SEQ ID NO: 3374 - RNA, 17 nt, Mus musculus
augaaguuccccuggau

SEQ ID NO: 3375 - RNA, 17 nt, Mus musculus
gcugcccuaugaugcca

SEQ ID NO: 3376 - RNA, 17 nt, Mus musculus
gugggaguuugcacggg

SEQ ID NO: 3377 - RNA, 17 nt, Mus musculus
ugggaguuugcacggga

SEQ ID NO: 3378 - RNA, 17 nt, Mus musculus
cugaaacuaggcaaauc

SEQ ID NO: 3379 - RNA, 17 nt, Mus musculus
aggcaaaucgcucggaa

SEQ ID NO: 3380 - RNA, 17 nt, Mus musculus
aaaucgcucggaagagg

SEQ ID NO: 3381 - RNA, 17 nt, Mus musculus
gaggggcuuuugggaaa

SEQ ID NO: 3382 - RNA, 17 nt, Mus musculus
aggggcuuuugggaaag

SEQ ID NO: 3383 - RNA, 17 nt, Mus musculus
ggggcuuuugggaaagu

SEQ ID NO: 3384 - RNA, 17 nt, Mus musculus
gggaaagucguucaagc

SEQ ID NO: 3385 - RNA, 17 nt, Mus musculus
aaagucguucaagccuc

SEQ ID NO: 3386 - RNA, 17 nt, Mus musculus
aagucguucaagccucu

SEQ ID NO: 3387 - RNA, 17 nt, Mus musculus
ucaagccucugcauuug

SEQ ID NO: 3388 - RNA, 17 nt, Mus musculus
cucugcauuuggcauua

SEQ ID NO: 3389 - RNA, 17 nt, Mus musculus
ucugcauuuggcauuaa

SEQ ID NO: 3390 - RNA, 17 nt, Mus musculus
uaagaaaucacccaccu

SEQ ID NO: 3391 - RNA, 17 nt, Mus musculus
gaagauguugaaagagg

SEQ ID NO: 3392 - RNA, 17 nt, Mus musculus
cagugaguacaaagcuc

SEQ ID NO: 3393 - RNA, 17 nt, Mus musculus
acaaagcucugaugacc

SEQ ID NO: 3394 - RNA, 17 nt, Mus musculus
accgaacucaagaucuu

SEQ ID NO: 3395 - RNA, 17 nt, Mus musculus
cucaagaucuugaccca

SEQ ID NO: 3396 - RNA, 17 nt, Mus musculus
caagaucuugacccaca

SEQ ID NO: 3397 - RNA, 17 nt, Mus musculus
acccacaucggccauca

SEQ ID NO: 3398 - RNA, 17 nt, Mus musculus
ucggccaucaucugaau

SEQ ID NO: 3399 - RNA, 17 nt, Mus musculus
gccaucaucugaaugug

SEQ ID NO: 3400 - RNA, 17 nt, Mus musculus
aaugugguuaaccuccu

SEQ ID NO: 3401 - RNA, 17 nt, Mus musculus
augugguuaaccuccug

SEQ ID NO: 3402 - RNA, 17 nt, Mus musculus
guuaaccuccugggagc

SEQ ID NO: 3403 - RNA, 17 nt, Mus musculus
auggugaucguggaaua

SEQ ID NO: 3404 - RNA, 17 nt, Mus musculus
cguggaauacugcaaau

SEQ ID NO: 3405 - RNA, 17 nt, Mus musculus
cugcaaauacggaaacc

SEQ ID NO: 3406 - RNA, 17 nt, Mus musculus
aaaccuguccaacuacc

SEQ ID NO: 3407 - RNA, 17 nt, Mus musculus
guccaacuaccucaaga

SEQ ID NO: 3408 - RNA, 17 nt, Mus musculus
acgugacuuauucuguc

SEQ ID NO: 3409 - RNA, 17 nt, Mus musculus
cgugacuuauucugucu

SEQ ID NO: 3410 - RNA, 17 nt, Mus musculus
ugacuuauucugucuca

SEQ ID NO: 3411 - RNA, 17 nt, Mus musculus
gacuuauucugucucaa

SEQ ID NO: 3412 - RNA, 17 nt, Mus musculus
uauucugucucaacaag

SEQ ID NO: 3413 - RNA, 17 nt, Mus musculus
uucugucucaacaagga

SEQ ID NO: 3414 - RNA, 17 nt, Mus musculus
cgcagccuugcauaugg

SEQ ID NO: 3415 - RNA, 17 nt, Mus musculus
ccuugcauauggagcuc

SEQ ID NO: 3416 - RNA, 17 nt, Mus musculus
auggagcucaagaaaga

SEQ ID NO: 3417 - RNA, 17 nt, Mus musculus
ccccgccuagacagugu

SEQ ID NO: 3418 - RNA, 17 nt, Mus musculus
gacagugucagcagcuc

SEQ ID NO: 3419 - RNA, 17 nt, Mus musculus
cagcagcucaaguguca

SEQ ID NO: 3420 - RNA, 17 nt, Mus musculus
ucaagugucaccagcuc

SEQ ID NO: 3421 - RNA, 17 nt, Mus musculus
caccagcuccagcuucc

SEQ ID NO: 3422 - RNA, 17 nt, Mus musculus
cuccagcuucccugaag

SEQ ID NO: 3423 - RNA, 17 nt, Mus musculus
uccagcuucccugaaga

SEQ ID NO: 3424 - RNA, 17 nt, Mus musculus
acgaggauuacagugag

SEQ ID NO: 3425 - RNA, 17 nt, Mus musculus
cgaggauuacagugaga

SEQ ID NO: 3426 - RNA, 17 nt, Mus musculus
agugagaucuccaagca

SEQ ID NO: 3427 - RNA, 17 nt, Mus musculus
ugagaucuccaagcagc

SEQ ID NO: 3428 - RNA, 17 nt, Mus musculus
cagccccucaccaugga

SEQ ID NO: 3429 - RNA, 17 nt, Mus musculus
gaccugauuuccuacag

SEQ ID NO: 3430 - RNA, 17 nt, Mus musculus
accugauuuccuacagu

SEQ ID NO: 3431 - RNA, 17 nt, Mus musculus
ccugauuuccuacaguu

SEQ ID NO: 3432 - RNA, 17 nt, Mus musculus
gauuuccuacaguuucc

SEQ ID NO: 3433 - RNA, 17 nt, Mus musculus
ccuacaguuuccaagug

SEQ ID NO: 3434 - RNA, 17 nt, Mus musculus
cuacaguuuccaagugg

SEQ ID NO: 3435 - RNA, 17 nt, Mus musculus
uacaguuuccaaguggc

SEQ ID NO: 3436 - RNA, 17 nt, Mus musculus
cauggaguuucuguccu

SEQ ID NO: 3437 - RNA, 17 nt, Mus musculus
auggaguuucuguccuc

SEQ ID NO: 3438 - RNA, 17 nt, Mus musculus
uggaguuucuguccucc

SEQ ID NO: 3439 - RNA, 17 nt, Mus musculus
guuucuguccuccagaa

SEQ ID NO: 3440 - RNA, 17 nt, Mus musculus
ucuguccuccagaaagu

SEQ ID NO: 3441 - RNA, 17 nt, Mus musculus
agaaacauccuuuuauc

SEQ ID NO: 3442 - RNA, 17 nt, Mus musculus
aacauccuuuuaucuga

SEQ ID NO: 3443 - RNA, 17 nt, Mus musculus
acauccuuuuaucugag

SEQ ID NO: 3444 - RNA, 17 nt, Mus musculus
cauccuuuuaucugaga

SEQ ID NO: 3445 - RNA, 17 nt, Mus musculus
auccuuuuaucugagaa

SEQ ID NO: 3446 - RNA, 17 nt, Mus musculus
ccuuuuaucugagaaca

SEQ ID NO: 3447 - RNA, 17 nt, Mus musculus
gugaagauuugcgacuu

SEQ ID NO: 3448 - RNA, 17 nt, Mus musculus
ugaagauuugcgacuuu

SEQ ID NO: 3449 - RNA, 17 nt, Mus musculus
uugcgacuuuggccugg

SEQ ID NO: 3450 - RNA, 17 nt, Mus musculus
ugcgacuuuggccuggc

SEQ ID NO: 3451 - RNA, 17 nt, Mus musculus
auauuuauaagaacccu

SEQ ID NO: 3452 - RNA, 17 nt, Mus musculus
acccugauuaugugagg

SEQ ID NO: 3453 - RNA, 17 nt, Mus musculus
cccugauuaugugagga

SEQ ID NO: 3454 - RNA, 17 nt, Mus musculus
gaggagauacucgacuu

SEQ ID NO: 3455 - RNA, 17 nt, Mus musculus
gagauacucgacuuccc

SEQ ID NO: 3456 - RNA, 17 nt, Mus musculus
acucgacuuccccuaaa

SEQ ID NO: 3457 - RNA, 17 nt, Mus musculus
cucgacuuccccuaaaa

SEQ ID NO: 3458 - RNA, 17 nt, Mus musculus
cuuccccuaaaauggau

SEQ ID NO: 3459 - RNA, 17 nt, Mus musculus
ggauggcuccugaaucc

SEQ ID NO: 3460 - RNA, 17 nt, Mus musculus
uccugaauccaucuuug

SEQ ID NO: 3461 - RNA, 17 nt, Mus musculus
gaauccaucuuugacaa

SEQ ID NO: 3462 - RNA, 17 nt, Mus musculus
auccaucuuugacaagg

SEQ ID NO: 3463 - RNA, 17 nt, Mus musculus
uccaucuuugacaaggu

SEQ ID NO: 3464 - RNA, 17 nt, Mus musculus
gacaaggucuacagcac

SEQ ID NO: 3465 - RNA, 17 nt, Mus musculus
caaggucuacagcacca

SEQ ID NO: 3466 - RNA, 17 nt, Mus musculus
ugugugguccuauggcg

SEQ ID NO: 3467 - RNA, 17 nt, Mus musculus
gugguccuauggcgugu

SEQ ID NO: 3468 - RNA, 17 nt, Mus musculus
uggcguguugcuguggg

SEQ ID NO: 3469 - RNA, 17 nt, Mus musculus
ugggagaucuucuccuu

SEQ ID NO: 3470 - RNA, 17 nt, Mus musculus
ggagaucuucuccuuag

SEQ ID NO: 3471 - RNA, 17 nt, Mus musculus
gagaucuucuccuuagg

SEQ ID NO: 3472 - RNA, 17 nt, Mus musculus
gaucuucuccuuagggg

SEQ ID NO: 3473 - RNA, 17 nt, Mus musculus
cuucuccuuaggggguu

SEQ ID NO: 3474 - RNA, 17 nt, Mus musculus
uucuccuuaggggguuc

SEQ ID NO: 3475 - RNA, 17 nt, Mus musculus
uaggggguucuccauac

SEQ ID NO: 3476 - RNA, 17 nt, Mus musculus
aggggguucuccauacc

SEQ ID NO: 3477 - RNA, 17 nt, Mus musculus
gggguucuccauaccca

SEQ ID NO: 3478 - RNA, 17 nt, Mus musculus
uucuccauacccaggag

SEQ ID NO: 3479 - RNA, 17 nt, Mus musculus
ugaagacuucugcagcc

SEQ ID NO: 3480 - RNA, 17 nt, Mus musculus
gaagacuucugcagccg

SEQ ID NO: 3481 - RNA, 17 nt, Mus musculus
cccggaguaugccacac

SEQ ID NO: 3482 - RNA, 17 nt, Mus musculus
ccugaaaucuaccaaau

SEQ ID NO: 3483 - RNA, 17 nt, Mus musculus
ugaaaucuaccaaauca

SEQ ID NO: 3484 - RNA, 17 nt, Mus musculus
uaccaaaucauguugga

SEQ ID NO: 3485 - RNA, 17 nt, Mus musculus
aaucauguuggauugcu

SEQ ID NO: 3486 - RNA, 17 nt, Mus musculus
uguuggauugcuggcac

SEQ ID NO: 3487 - RNA, 17 nt, Mus musculus
gccccgguuugcugaac

SEQ ID NO: 3488 - RNA, 17 nt, Mus musculus
ccccgguuugcugaacu

SEQ ID NO: 3489 - RNA, 17 nt, Mus musculus
gcugaacuuguggagaa

SEQ ID NO: 3490 - RNA, 17 nt, Mus musculus
gagaaacuuggugaccu

SEQ ID NO: 3491 - RNA, 17 nt, Mus musculus
gaccugcuucaagccaa

SEQ ID NO: 3492 - RNA, 17 nt, Mus musculus
accugcuucaagccaac

SEQ ID NO: 3493 - RNA, 17 nt, Mus musculus
gccaacguccaacagga

SEQ ID NO: 3494 - RNA, 17 nt, Mus musculus
ggaaagauuacaucccc

SEQ ID NO: 3495 - RNA, 17 nt, Mus musculus
gaaagauuacauccccc

SEQ ID NO: 3496 - RNA, 17 nt, Mus musculus
gauuacaucccccucaa

SEQ ID NO: 3497 - RNA, 17 nt, Mus musculus
aucccccucaaugccau

SEQ ID NO: 3498 - RNA, 17 nt, Mus musculus
aaugccauacugacuag

SEQ ID NO: 3499 - RNA, 17 nt, Mus musculus
uacugacuagaaacagu

SEQ ID NO: 3500 - RNA, 17 nt, Mus musculus
gaaacaguagcuucaca

SEQ ID NO: 3501 - RNA, 17 nt, Mus musculus
caguagcuucacauacu

SEQ ID NO: 3502 - RNA, 17 nt, Mus musculus
aguagcuucacauacuc

SEQ ID NO: 3503 - RNA, 17 nt, Mus musculus
cuucacauacucgaccc

SEQ ID NO: 3504 - RNA, 17 nt, Mus musculus
cacauacucgaccccca

SEQ ID NO: 3505 - RNA, 17 nt, Mus musculus
ccccaccuucucugagg

SEQ ID NO: 3506 - RNA, 17 nt, Mus musculus
cccaccuucucugagga

SEQ ID NO: 3507 - RNA, 17 nt, Mus musculus
caccuucucugaggacc

SEQ ID NO: 3508 - RNA, 17 nt, Mus musculus
gaggaccuuuucaagga

SEQ ID NO: 3509 - RNA, 17 nt, Mus musculus
aggaccuuuucaaggac

SEQ ID NO: 3510 - RNA, 17 nt, Mus musculus
ggaccuuuucaaggacg

SEQ ID NO: 3511 - RNA, 17 nt, Mus musculus
gaccuuuucaaggacgg

SEQ ID NO: 3512 - RNA, 17 nt, Mus musculus
ggacggcuuugcagauc

SEQ ID NO: 3513 - RNA, 17 nt, Mus musculus
gacggcuuugcagaucc

SEQ ID NO: 3514 - RNA, 17 nt, Mus musculus
uugcagauccacauuuu

SEQ ID NO: 3515 - RNA, 17 nt, Mus musculus
auccacauuuucauucc

SEQ ID NO: 3516 - RNA, 17 nt, Mus musculus
uccacauuuucauuccg

SEQ ID NO: 3517 - RNA, 17 nt, Mus musculus
ccacauuuucauuccgg

SEQ ID NO: 3518 - RNA, 17 nt, Mus musculus
cacauuuucauuccgga

SEQ ID NO: 3519 - RNA, 17 nt, Mus musculus
auuuucauuccggaagc

SEQ ID NO: 3520 - RNA, 17 nt, Mus musculus
uuuucauuccggaagcu

SEQ ID NO: 3521 - RNA, 17 nt, Mus musculus
cggaagcucugaugaug

SEQ ID NO: 3522 - RNA, 17 nt, Mus musculus
ugugagauauguaaacg

SEQ ID NO: 3523 - RNA, 17 nt, Mus musculus
agauauguaaacgcuuu

SEQ ID NO: 3524 - RNA, 17 nt, Mus musculus
uaaacgcuuucaaauuc

SEQ ID NO: 3525 - RNA, 17 nt, Mus musculus
aaacgcuuucaaauuca

SEQ ID NO: 3526 - RNA, 17 nt, Mus musculus
aacgcuuucaaauucau

SEQ ID NO: 3527 - RNA, 17 nt, Mus musculus
uuucaaauucaugagcc

SEQ ID NO: 3528 - RNA, 17 nt, Mus musculus
uucaaauucaugagccu

SEQ ID NO: 3529 - RNA, 17 nt, Mus musculus
caaaaccuuugaggagc

SEQ ID NO: 3530 - RNA, 17 nt, Mus musculus
aaaaccuuugaggagcu

SEQ ID NO: 3531 - RNA, 17 nt, Mus musculus
gaggagcuuucaccgaa

SEQ ID NO: 3532 - RNA, 17 nt, Mus musculus
aggagcuuucaccgaac

SEQ ID NO: 3533 - RNA, 17 nt, Mus musculus
ggagcuuucaccgaacu

SEQ ID NO: 3534 - RNA, 17 nt, Mus musculus
accgaacuccaccucca

SEQ ID NO: 3535 - RNA, 17 nt, Mus musculus
cuccaccuccauguuug

SEQ ID NO: 3536 - RNA, 17 nt, Mus musculus
cuccauguuugaggacu

SEQ ID NO: 3537 - RNA, 17 nt, Mus musculus
uccauguuugaggacua

SEQ ID NO: 3538 - RNA, 17 nt, Mus musculus
ugaggacuaucagcugg

SEQ ID NO: 3539 - RNA, 17 nt, Mus musculus
aggacuaucagcuggac

SEQ ID NO: 3540 - RNA, 17 nt, Mus musculus
uggacacuagcacucug

SEQ ID NO: 3541 - RNA, 17 nt, Mus musculus
cuagcacucugcugggc

SEQ ID NO: 3542 - RNA, 17 nt, Mus musculus
gcugggcucccccuugc

SEQ ID NO: 3543 - RNA, 17 nt, Mus musculus
cucccccuugcugaagc

SEQ ID NO: 3544 - RNA, 17 nt, Mus musculus
gaagcgguucaccugga

SEQ ID NO: 3545 - RNA, 17 nt, Mus musculus
aagcgguucaccuggac

SEQ ID NO: 3546 - RNA, 17 nt, Mus musculus
caaggccuccaugaaga

SEQ ID NO: 3547 - RNA, 17 nt, Mus musculus
augaagauagacuugag

SEQ ID NO: 3548 - RNA, 17 nt, Mus musculus
gauagacuugagaauag

SEQ ID NO: 3549 - RNA, 17 nt, Mus musculus
uugagaauagcgaguaa

SEQ ID NO: 3550 - RNA, 17 nt, Mus musculus
uagcgaguaaaagcaag

SEQ ID NO: 3551 - RNA, 17 nt, Mus musculus
gcgggacuuuccgaucu

SEQ ID NO: 3552 - RNA, 17 nt, Mus musculus
cgggacuuuccgaucug

SEQ ID NO: 3553 - RNA, 17 nt, Mus musculus
gggacuuuccgaucugc

SEQ ID NO: 3554 - RNA, 17 nt, Mus musculus
uuuccgaucugccgagg

SEQ ID NO: 3555 - RNA, 17 nt, Mus musculus
gcccagcuucugcuucu

SEQ ID NO: 3556 - RNA, 17 nt, Mus musculus
cccagcuucugcuucuc

SEQ ID NO: 3557 - RNA, 17 nt, Mus musculus
cuucugcuucuccagcu

SEQ ID NO: 3558 - RNA, 17 nt, Mus musculus
uucugcuucuccagcug

SEQ ID NO: 3559 - RNA, 17 nt, Mus musculus
cugcuucuccagcugug

SEQ ID NO: 3560 - RNA, 17 nt, Mus musculus
ggccacaucaggcccgu

SEQ ID NO: 3561 - RNA, 17 nt, Mus musculus
cgaugaaucugagcugg

SEQ ID NO: 3562 - RNA, 17 nt, Mus musculus
aaaggaguccugcuguu

SEQ ID NO: 3563 - RNA, 17 nt, Mus musculus
ccugcuguucuccaccc

SEQ ID NO: 3564 - RNA, 17 nt, Mus musculus
cugcuguucuccacccc

SEQ ID NO: 3565 - RNA, 17 nt, Mus musculus
gcuguucuccaccccca

SEQ ID NO: 3566 - RNA, 17 nt, Mus musculus
cccagacuacaacuccg

SEQ ID NO: 3567 - RNA, 17 nt, Mus musculus
cuacaacuccguggugu

SEQ ID NO: 3568 - RNA, 17 nt, Mus musculus
cgugguguuguacuccu

SEQ ID NO: 3569 - RNA, 17 nt, Mus musculus
gguguuguacuccuccc

SEQ ID NO: 3570 - RNA, 17 nt, Mus musculus
guuguacuccuccccgc

SEQ ID NO: 3571 - RNA, 17 nt, Mus musculus
guacuccuccccgcccg

SEQ ID NO: 3572 - RNA, 17 nt, Mus musculus
gcccgccuaaagcuucu

SEQ ID NO: 3573 - RNA, 17 nt, Mus musculus
cuaaagcuucucaccag

SEQ ID NO: 3574 - RNA, 17 nt, Mus musculus
uaaagcuucucaccagc

SEQ ID NO: 3575 - RNA, 17 nt, Mus musculus
aagcuucucaccagccc

SEQ ID NO: 3576 - RNA, 17 nt, Mus musculus
cugacaguauuauacau

SEQ ID NO: 3577 - RNA, 17 nt, Mus musculus
gacaguauuauacaucu

SEQ ID NO: 3578 - RNA, 17 nt, Mus musculus
acaguauuauacaucua

SEQ ID NO: 3579 - RNA, 17 nt, Mus musculus
aguauuauacaucuaug

SEQ ID NO: 3580 - RNA, 17 nt, Mus musculus
uuauacaucuaugaguu

SEQ ID NO: 3581 - RNA, 17 nt, Mus musculus
auacaucuaugaguuua

SEQ ID NO: 3582 - RNA, 17 nt, Mus musculus
cuaugaguuuacaccua

SEQ ID NO: 3583 - RNA, 17 nt, Mus musculus
uaugaguuuacaccuau

SEQ ID NO: 3584 - RNA, 17 nt, Mus musculus
augaguuuacaccuauu

SEQ ID NO: 3585 - RNA, 17 nt, Mus musculus
uuacaccuauuccgcuc

SEQ ID NO: 3586 - RNA, 17 nt, Mus musculus
acaccuauuccgcucca

SEQ ID NO: 3587 - RNA, 17 nt, Mus musculus
caccuauuccgcuccac

SEQ ID NO: 3588 - RNA, 17 nt, Mus musculus
auuccgcuccacaggag

SEQ ID NO: 3589 - RNA, 17 nt, Mus musculus
cagcugcuuuucgugac

SEQ ID NO: 3590 - RNA, 17 nt, Mus musculus
agcugcuuuucgugacc

SEQ ID NO: 3591 - RNA, 17 nt, Mus musculus
gcugcuuuucgugaccu

SEQ ID NO: 3592 - RNA, 17 nt, Mus musculus
cugcuuuucgugaccuu

SEQ ID NO: 3593 - RNA, 17 nt, Mus musculus
cgugaccuuuaaucgug

SEQ ID NO: 3594 - RNA, 17 nt, Mus musculus
gugaccuuuaaucgugc

SEQ ID NO: 3595 - RNA, 17 nt, Mus musculus
ugaccuuuaaucgugcu

SEQ ID NO: 3596 - RNA, 17 nt, Mus musculus
ccuuuaaucgugcuuuu

SEQ ID NO: 3597 - RNA, 17 nt, Mus musculus
aucgugcuuuuuuguuu

SEQ ID NO: 3598 - RNA, 17 nt, Mus musculus
ucgugcuuuuuuguuuu

SEQ ID NO: 3599 - RNA, 17 nt, Mus musculus
cgugcuuuuuuguuuuu

SEQ ID NO: 3600 - RNA, 17 nt, Mus musculus
gugcuuuuuuguuuuuu

SEQ ID NO: 3601 - RNA, 17 nt, Mus musculus
ugcuuuuuuguuuuuug

SEQ ID NO: 3602 - RNA, 17 nt, Mus musculus
uuuuuuguuuuuuguuu

SEQ ID NO: 3603 - RNA, 17 nt, Mus musculus
uuuuuguuuuuuguuuu

SEQ ID NO: 3604 - RNA, 17 nt, Mus musculus
uuuuguuuuuuguuuug

SEQ ID NO: 3605 - RNA, 17 nt, Mus musculus
uuuguuuuuuguuuugu

SEQ ID NO: 3606 - RNA, 17 nt, Mus musculus
uuguuuuuuguuuuguu

SEQ ID NO: 3607 - RNA, 17 nt, Mus musculus
uuuuuuguuuuguuugu

SEQ ID NO: 3608 - RNA, 17 nt, Mus musculus
uuuuuguuuuguuuguu

SEQ ID NO: 3609 - RNA, 17 nt, Mus musculus
uuuuguuuuguuuguug

SEQ ID NO: 3610 - RNA, 17 nt, Mus musculus
uguuuuguuuguuguug

SEQ ID NO: 3611 - RNA, 17 nt, Mus musculus
guuuuguuuguuguugc

SEQ ID NO: 3612 - RNA, 17 nt, Mus musculus
uuguuuguuguugcugu

SEQ ID NO: 3613 - RNA, 17 nt, Mus musculus
uuuguuguugcuguuuu

SEQ ID NO: 3614 - RNA, 17 nt, Mus musculus
guugcuguuuugacuaa

SEQ ID NO: 3615 - RNA, 17 nt, Mus musculus
uugcuguuuugacuaac

SEQ ID NO: 3616 - RNA, 17 nt, Mus musculus
ugcuguuuugacuaaca

SEQ ID NO: 3617 - RNA, 17 nt, Mus musculus
aagaauguaaccccagu

SEQ ID NO: 3618 - RNA, 17 nt, Mus musculus
accccaguuagugacgu

SEQ ID NO: 3619 - RNA, 17 nt, Mus musculus
ccccaguuagugacgug

SEQ ID NO: 3620 - RNA, 17 nt, Mus musculus
ugaagaauacuauuguu

SEQ ID NO: 3621 - RNA, 17 nt, Mus musculus
agaauacuauuguuaga

SEQ ID NO: 3622 - RNA, 17 nt, Mus musculus
aauacuauuguuagaga

SEQ ID NO: 3623 - RNA, 17 nt, Mus musculus
acuauuguuagagaaau

SEQ ID NO: 3624 - RNA, 17 nt, Mus musculus
cuauuguuagagaaauc

SEQ ID NO: 3625 - RNA, 17 nt, Mus musculus
agagaaaucccccccgc

SEQ ID NO: 3626 - RNA, 17 nt, Mus musculus
caaagccucaggguaac

SEQ ID NO: 3627 - RNA, 17 nt, Mus musculus
cucaggguaaccuggac

SEQ ID NO: 3628 - RNA, 17 nt, Mus musculus
aggugccucuggcgacc

SEQ ID NO: 3629 - RNA, 17 nt, Mus musculus
cccacccucccugcagc

SEQ ID NO: 3630 - RNA, 17 nt, Mus musculus
gugggacuagaggcagu

SEQ ID NO: 3631 - RNA, 17 nt, Mus musculus
gaggcaguaagcccauu

SEQ ID NO: 3632 - RNA, 17 nt, Mus musculus
aagcccauuagcucaug

SEQ ID NO: 3633 - RNA, 17 nt, Mus musculus
agcccauuagcucaugg

SEQ ID NO: 3634 - RNA, 17 nt, Mus musculus
cauuagcucauggcugc

SEQ ID NO: 3635 - RNA, 17 nt, Mus musculus
gaccugcucugucucuc

SEQ ID NO: 3636 - RNA, 17 nt, Mus musculus
ugcucugucucucuuau

SEQ ID NO: 3637 - RNA, 17 nt, Mus musculus
cucugucucucuuaugg

SEQ ID NO: 3638 - RNA, 17 nt, Mus musculus
cugucucucuuauggag

SEQ ID NO: 3639 - RNA, 17 nt, Mus musculus
gucucucuuauggagga

SEQ ID NO: 3640 - RNA, 17 nt, Mus musculus
ucucucuuauggaggaa

SEQ ID NO: 3641 - RNA, 17 nt, Mus musculus
aaaaggcuuugggaugc

SEQ ID NO: 3642 - RNA, 17 nt, Mus musculus
aaaggcuuugggaugcg

SEQ ID NO: 3643 - RNA, 17 nt, Mus musculus
ggaugcguccguccugu

SEQ ID NO: 3644 - RNA, 17 nt, Mus musculus
gcguccguccuguggag

SEQ ID NO: 3645 - RNA, 17 nt, Mus musculus
agggggcuccgcuaugc

SEQ ID NO: 3646 - RNA, 17 nt, Mus musculus
gcuccgcuaugccacuu

SEQ ID NO: 3647 - RNA, 17 nt, Mus musculus
augccacuucagugacu

SEQ ID NO: 3648 - RNA, 17 nt, Mus musculus
ugccacuucagugacuu

SEQ ID NO: 3649 - RNA, 17 nt, Mus musculus
cagugacuucucacucc

SEQ ID NO: 3650 - RNA, 17 nt, Mus musculus
agugacuucucacuccu

SEQ ID NO: 3651 - RNA, 17 nt, Mus musculus
ugacuucucacuccugg

SEQ ID NO: 3652 - RNA, 17 nt, Mus musculus
uucucacuccuggccuc

SEQ ID NO: 3653 - RNA, 17 nt, Mus musculus
ccuggccuccgcuguuu

SEQ ID NO: 3654 - RNA, 17 nt, Mus musculus
uccgcuguuucgggccc

SEQ ID NO: 3655 - RNA, 17 nt, Mus musculus
ccgcuguuucgggcccc

SEQ ID NO: 3656 - RNA, 17 nt, Mus musculus
cgcuguuucgggccccc

SEQ ID NO: 3657 - RNA, 17 nt, Mus musculus
ggcccccuuccaagagg

SEQ ID NO: 3658 - RNA, 17 nt, Mus musculus
gcccccuuccaagaggu

SEQ ID NO: 3659 - RNA, 17 nt, Mus musculus
caagagguaucagagca

SEQ ID NO: 3660 - RNA, 17 nt, Mus musculus
agagguaucagagcaga

SEQ ID NO: 3661 - RNA, 17 nt, Mus musculus
agggacguuuccuagac

SEQ ID NO: 3662 - RNA, 17 nt, Mus musculus
gggacguuuccuagacc

SEQ ID NO: 3663 - RNA, 17 nt, Mus musculus
ggacguuuccuagacca

SEQ ID NO: 3664 - RNA, 17 nt, Mus musculus
cguuuccuagaccaggg

SEQ ID NO: 3665 - RNA, 17 nt, Mus musculus
gcacauguucucgggaa

SEQ ID NO: 3666 - RNA, 17 nt, Mus musculus
cacauguucucgggaac

SEQ ID NO: 3667 - RNA, 17 nt, Mus musculus
cauguucucgggaacca

SEQ ID NO: 3668 - RNA, 17 nt, Mus musculus
accacaguuaaucuuaa

SEQ ID NO: 3669 - RNA, 17 nt, Mus musculus
ccacaguuaaucuuaaa

SEQ ID NO: 3670 - RNA, 17 nt, Mus musculus
caguuaaucuuaaaucu

SEQ ID NO: 3671 - RNA, 17 nt, Mus musculus
guuaaucuuaaaucuuu

SEQ ID NO: 3672 - RNA, 17 nt, Mus musculus
uuaaucuuaaaucuuuu

SEQ ID NO: 3673 - RNA, 17 nt, Mus musculus
ucuuaaaucuuuucccg

SEQ ID NO: 3674 - RNA, 17 nt, Mus musculus
uuaaaucuuuucccggg

SEQ ID NO: 3675 - RNA, 17 nt, Mus musculus
uaaaucuuuucccggga

SEQ ID NO: 3676 - RNA, 17 nt, Mus musculus
aaaucuuuucccgggag

SEQ ID NO: 3677 - RNA, 17 nt, Mus musculus
aaucuuuucccgggagu

SEQ ID NO: 3678 - RNA, 17 nt, Mus musculus
ccgggagucuucuguug

SEQ ID NO: 3679 - RNA, 17 nt, Mus musculus
gggagucuucuguuguc

SEQ ID NO: 3680 - RNA, 17 nt, Mus musculus
ggagucuucuguugucu

SEQ ID NO: 3681 - RNA, 17 nt, Mus musculus
ucuucuguugucuguuu

SEQ ID NO: 3682 - RNA, 17 nt, Mus musculus
ucuguugucuguuuacc

SEQ ID NO: 3683 - RNA, 17 nt, Mus musculus
uugucuguuuaccaucc

SEQ ID NO: 3684 - RNA, 17 nt, Mus musculus
ugucuguuuaccaucca

SEQ ID NO: 3685 - RNA, 17 nt, Mus musculus
gucuguuuaccauccaa

SEQ ID NO: 3686 - RNA, 17 nt, Mus musculus
uuuaccauccaaagcau

SEQ ID NO: 3687 - RNA, 17 nt, Mus musculus
caaagcauauuuaacau

SEQ ID NO: 3688 - RNA, 17 nt, Mus musculus
aagcauauuuaacaugu

SEQ ID NO: 3689 - RNA, 17 nt, Mus musculus
agcauauuuaacaugug

SEQ ID NO: 3690 - RNA, 17 nt, Mus musculus
gcauauuuaacaugugu

SEQ ID NO: 3691 - RNA, 17 nt, Mus musculus
acaugugucaguggggg

SEQ ID NO: 3692 - RNA, 17 nt, Mus musculus
guggcgcuuggcuucug

SEQ ID NO: 3693 - RNA, 17 nt, Mus musculus
gcuuggcuucugaggcc

SEQ ID NO: 3694 - RNA, 17 nt, Mus musculus
cuuggcuucugaggcca

SEQ ID NO: 3695 - RNA, 17 nt, Mus musculus
agagccaucaucaguuc

SEQ ID NO: 3696 - RNA, 17 nt, Mus musculus
gccaucaucaguuccuc

SEQ ID NO: 3697 - RNA, 17 nt, Mus musculus
ucaucaguuccucuagu

SEQ ID NO: 3698 - RNA, 17 nt, Mus musculus
caucaguuccucuagug

SEQ ID NO: 3699 - RNA, 17 nt, Mus musculus
caguuccucuagugaga

SEQ ID NO: 3700 - RNA, 17 nt, Mus musculus
guuccucuagugagaug

SEQ ID NO: 3701 - RNA, 17 nt, Mus musculus
agaugcauugaggucau

SEQ ID NO: 3702 - RNA, 17 nt, Mus musculus
auugaggucauacccaa

SEQ ID NO: 3703 - RNA, 17 nt, Mus musculus
gaggucauacccaagcu

SEQ ID NO: 3704 - RNA, 17 nt, Mus musculus
cccaagcuugcaggccu

SEQ ID NO: 3705 - RNA, 17 nt, Mus musculus
ccugaccuucgcauacu

SEQ ID NO: 3706 - RNA, 17 nt, Mus musculus
cugaccuucgcauacug

SEQ ID NO: 3707 - RNA, 17 nt, Mus musculus
cuucgcauacugcucac

SEQ ID NO: 3708 - RNA, 17 nt, Mus musculus
auacugcucacggggag

SEQ ID NO: 3709 - RNA, 17 nt, Mus musculus
cggggaguuaagugguc

SEQ ID NO: 3710 - RNA, 17 nt, Mus musculus
ggggaguuaaguggucc

SEQ ID NO: 3711 - RNA, 17 nt, Mus musculus
uaagugguccaguuugg

SEQ ID NO: 3712 - RNA, 17 nt, Mus musculus
gguccaguuuggccuag

SEQ ID NO: 3713 - RNA, 17 nt, Mus musculus
guccaguuuggccuagu

SEQ ID NO: 3714 - RNA, 17 nt, Mus musculus
uuuggccuaguaagguu

SEQ ID NO: 3715 - RNA, 17 nt, Mus musculus
ggccuaguaagguugcc

SEQ ID NO: 3716 - RNA, 17 nt, Mus musculus
aguaagguugccuacug

SEQ ID NO: 3717 - RNA, 17 nt, Mus musculus
gguugccuacugauggg

SEQ ID NO: 3718 - RNA, 17 nt, Mus musculus
gaugggcucaaaagcca

SEQ ID NO: 3719 - RNA, 17 nt, Mus musculus
agccacauuuuaaacag

SEQ ID NO: 3720 - RNA, 17 nt, Mus musculus
gccacauuuuaaacagg

SEQ ID NO: 3721 - RNA, 17 nt, Mus musculus
ccacauuuuaaacaggu

SEQ ID NO: 3722 - RNA, 17 nt, Mus musculus
cacauuuuaaacagguu

SEQ ID NO: 3723 - RNA, 17 nt, Mus musculus
aaacagguuuuaucuca

SEQ ID NO: 3724 - RNA, 17 nt, Mus musculus
aacagguuuuaucucaa

SEQ ID NO: 3725 - RNA, 17 nt, Mus musculus
acagguuuuaucucaag

SEQ ID NO: 3726 - RNA, 17 nt, Mus musculus
cagguuuuaucucaagu

SEQ ID NO: 3727 - RNA, 17 nt, Mus musculus
gguuuuaucucaaguau

SEQ ID NO: 3728 - RNA, 17 nt, Mus musculus
uuuuaucucaaguauua

SEQ ID NO: 3729 - RNA, 17 nt, Mus musculus
ucucaaguauuaauaua

SEQ ID NO: 3730 - RNA, 17 nt, Mus musculus
ucaaguauuaauauaua

SEQ ID NO: 3731 - RNA, 17 nt, Mus musculus
caaguauuaauauauag

SEQ ID NO: 3732 - RNA, 17 nt, Mus musculus
guauuaauauauagaca

SEQ ID NO: 3733 - RNA, 17 nt, Mus musculus
auuaauauauagacaag

SEQ ID NO: 3734 - RNA, 17 nt, Mus musculus
uaauauauagacaagac

SEQ ID NO: 3735 - RNA, 17 nt, Mus musculus
aagacacuuaugcauua

SEQ ID NO: 3736 - RNA, 17 nt, Mus musculus
agacacuuaugcauuau

SEQ ID NO: 3737 - RNA, 17 nt, Mus musculus
uuaugcauuauccuguu

SEQ ID NO: 3738 - RNA, 17 nt, Mus musculus
uaugcauuauccuguuu

SEQ ID NO: 3739 - RNA, 17 nt, Mus musculus
ugcauuauccuguuuua

SEQ ID NO: 3740 - RNA, 17 nt, Mus musculus
uauccuguuuuauauau

SEQ ID NO: 3741 - RNA, 17 nt, Mus musculus
auccuguuuuauauauc

SEQ ID NO: 3742 - RNA, 17 nt, Mus musculus
uccuguuuuauauaucc

SEQ ID NO: 3743 - RNA, 17 nt, Mus musculus
ccuguuuuauauaucca

SEQ ID NO: 3744 - RNA, 17 nt, Mus musculus
uguuuuauauauccaau

SEQ ID NO: 3745 - RNA, 17 nt, Mus musculus
uuuuauauauccaauga

SEQ ID NO: 3746 - RNA, 17 nt, Mus musculus
uuauauauccaaugaau

SEQ ID NO: 3747 - RNA, 17 nt, Mus musculus
caaugaauauaacuggg

SEQ ID NO: 3748 - RNA, 17 nt, Mus musculus
augaauauaacuggggc

SEQ ID NO: 3749 - RNA, 17 nt, Mus musculus
gggcgaguuaagaguca

SEQ ID NO: 3750 - RNA, 17 nt, Mus musculus
ggcgaguuaagagucau

SEQ ID NO: 3751 - RNA, 17 nt, Mus musculus
uuaagagucauggucua

SEQ ID NO: 3752 - RNA, 17 nt, Mus musculus
gucauggucuagaaaag

SEQ ID NO: 3753 - RNA, 17 nt, Mus musculus
cauggucuagaaaaggg

SEQ ID NO: 3754 - RNA, 17 nt, Mus musculus
aaagggguuucucugua

SEQ ID NO: 3755 - RNA, 17 nt, Mus musculus
aagggguuucucuguac

SEQ ID NO: 3756 - RNA, 17 nt, Mus musculus
agggguuucucuguacc

SEQ ID NO: 3757 - RNA, 17 nt, Mus musculus
ggguuucucuguaccca

SEQ ID NO: 3758 - RNA, 17 nt, Mus musculus
uucucuguacccaaauc

SEQ ID NO: 3759 - RNA, 17 nt, Mus musculus
acccaaaucgggcuggu

SEQ ID NO: 3760 - RNA, 17 nt, Mus musculus
gggcugguuggaccaag

SEQ ID NO: 3761 - RNA, 17 nt, Mus musculus
agagugguugucccagc

SEQ ID NO: 3762 - RNA, 17 nt, Mus musculus
gugguugucccagcuau

SEQ ID NO: 3763 - RNA, 17 nt, Mus musculus
ucccagcuauaguuacu

SEQ ID NO: 3764 - RNA, 17 nt, Mus musculus
ccagcuauaguuacuaa

SEQ ID NO: 3765 - RNA, 17 nt, Mus musculus
gcuauaguuacuaaacu

SEQ ID NO: 3766 - RNA, 17 nt, Mus musculus
cuauaguuacuaaacua

SEQ ID NO: 3767 - RNA, 17 nt, Mus musculus
uaguuacuaaacuacuc

SEQ ID NO: 3768 - RNA, 17 nt, Mus musculus
acuaaacuacucaccca

SEQ ID NO: 3769 - RNA, 17 nt, Mus musculus
aaacuacucacccaaag

SEQ ID NO: 3770 - RNA, 17 nt, Mus musculus
cccaaaguugggaccuc

SEQ ID NO: 3771 - RNA, 17 nt, Mus musculus
ugggaccucacuggcuu

SEQ ID NO: 3772 - RNA, 17 nt, Mus musculus
cacuggcuucucuuuac

SEQ ID NO: 3773 - RNA, 17 nt, Mus musculus
acuggcuucucuuuacu

SEQ ID NO: 3774 - RNA, 17 nt, Mus musculus
uggcuucucuuuacuuc

SEQ ID NO: 3775 - RNA, 17 nt, Mus musculus
gcuucucuuuacuucau

SEQ ID NO: 3776 - RNA, 17 nt, Mus musculus
cuucucuuuacuucauc

SEQ ID NO: 3777 - RNA, 17 nt, Mus musculus
uucucuuuacuucauca

SEQ ID NO: 3778 - RNA, 17 nt, Mus musculus
ucuuuacuucaucaugg

SEQ ID NO: 3779 - RNA, 17 nt, Mus musculus
cuuuacuucaucaugga

SEQ ID NO: 3780 - RNA, 17 nt, Mus musculus
uacuucaucauggauuu

SEQ ID NO: 3781 - RNA, 17 nt, Mus musculus
ucauggauuucaccauc

SEQ ID NO: 3782 - RNA, 17 nt, Mus musculus
cauggauuucaccaucc

SEQ ID NO: 3783 - RNA, 17 nt, Mus musculus
auggauuucaccauccc

SEQ ID NO: 3784 - RNA, 17 nt, Mus musculus
uucaccaucccaaggca

SEQ ID NO: 3785 - RNA, 17 nt, Mus musculus
aaggcagucugagagga

SEQ ID NO: 3786 - RNA, 17 nt, Mus musculus
gaggagcuaaagaguau

SEQ ID NO: 3787 - RNA, 17 nt, Mus musculus
uaaagaguaucagccca

SEQ ID NO: 3788 - RNA, 17 nt, Mus musculus
aagaguaucagcccaua

SEQ ID NO: 3789 - RNA, 17 nt, Mus musculus
cagcccauauuuauuaa

SEQ ID NO: 3790 - RNA, 17 nt, Mus musculus
gcccauauuuauuaagc

SEQ ID NO: 3791 - RNA, 17 nt, Mus musculus
cccauauuuauuaagca

SEQ ID NO: 3792 - RNA, 17 nt, Mus musculus
ccauauuuauuaagcac

SEQ ID NO: 3793 - RNA, 17 nt, Mus musculus
auauuuauuaagcacuu

SEQ ID NO: 3794 - RNA, 17 nt, Mus musculus
uauuuauuaagcacuuu

SEQ ID NO: 3795 - RNA, 17 nt, Mus musculus
uaagcacuuuaugcucc

SEQ ID NO: 3796 - RNA, 17 nt, Mus musculus
aagcacuuuaugcuccu

SEQ ID NO: 3797 - RNA, 17 nt, Mus musculus
agcacuuuaugcuccuu

SEQ ID NO: 3798 - RNA, 17 nt, Mus musculus
uuuaugcuccuuggcac

SEQ ID NO: 3799 - RNA, 17 nt, Mus musculus
augcuccuuggcacagc

SEQ ID NO: 3800 - RNA, 17 nt, Mus musculus
ugauguguaauuuaugc

SEQ ID NO: 3801 - RNA, 17 nt, Mus musculus
uguguaauuuaugcaag

SEQ ID NO: 3802 - RNA, 17 nt, Mus musculus
guguaauuuaugcaagc

SEQ ID NO: 3803 - RNA, 17 nt, Mus musculus
uguaauuuaugcaagcu

SEQ ID NO: 3804 - RNA, 17 nt, Mus musculus
ugcaagcucccucucca

SEQ ID NO: 3805 - RNA, 17 nt, Mus musculus
agcucccucuccagcua

SEQ ID NO: 3806 - RNA, 17 nt, Mus musculus
cucccucuccagcuagg

SEQ ID NO: 3807 - RNA, 17 nt, Mus musculus
cuccagcuaggacucag

SEQ ID NO: 3808 - RNA, 17 nt, Mus musculus
cuaggacucaggauauu

SEQ ID NO: 3809 - RNA, 17 nt, Mus musculus
cucaggauauuagucaa

SEQ ID NO: 3810 - RNA, 17 nt, Mus musculus
caggauauuagucaaug

SEQ ID NO: 3811 - RNA, 17 nt, Mus musculus
aggauauuagucaauga

SEQ ID NO: 3812 - RNA, 17 nt, Mus musculus
auauuagucaaugagcc

SEQ ID NO: 3813 - RNA, 17 nt, Mus musculus
ugagccaucaaaaggaa

SEQ ID NO: 3814 - RNA, 17 nt, Mus musculus
aaaaaccuaucuuauuu

SEQ ID NO: 3815 - RNA, 17 nt, Mus musculus
aaaccuaucuuauuuuc

SEQ ID NO: 3816 - RNA, 17 nt, Mus musculus
accuaucuuauuuucau

SEQ ID NO: 3817 - RNA, 17 nt, Mus musculus
ccuaucuuauuuucauc

SEQ ID NO: 3818 - RNA, 17 nt, Mus musculus
uaucuuauuuucaucug

SEQ ID NO: 3819 - RNA, 17 nt, Mus musculus
aucuuauuuucaucugu

SEQ ID NO: 3820 - RNA, 17 nt, Mus musculus
ucuuauuuucaucuguu

SEQ ID NO: 3821 - RNA, 17 nt, Mus musculus
cuuauuuucaucuguuu

SEQ ID NO: 3822 - RNA, 17 nt, Mus musculus
auuuucaucuguuucau

SEQ ID NO: 3823 - RNA, 17 nt, Mus musculus
ucaucuguuucauaccu

SEQ ID NO: 3824 - RNA, 17 nt, Mus musculus
caucuguuucauaccuu

SEQ ID NO: 3825 - RNA, 17 nt, Mus musculus
aucuguuucauaccuug

SEQ ID NO: 3826 - RNA, 17 nt, Mus musculus
uguuucauaccuugucu

SEQ ID NO: 3827 - RNA, 17 nt, Mus musculus
ucauaccuugucugggg

SEQ ID NO: 3828 - RNA, 17 nt, Mus musculus
uaccuugucuggggucu

SEQ ID NO: 3829 - RNA, 17 nt, Mus musculus
ucuggggucuaaugacg

SEQ ID NO: 3830 - RNA, 17 nt, Mus musculus
uggggucuaaugacgau

SEQ ID NO: 3831 - RNA, 17 nt, Mus musculus
aacaggguagacauggg

SEQ ID NO: 3832 - RNA, 17 nt, Mus musculus
gacaggguagaaaaggg

SEQ ID NO: 3833 - RNA, 17 nt, Mus musculus
ugcccgcucuuuggggu

SEQ ID NO: 3834 - RNA, 17 nt, Mus musculus
cccgcucuuuggggucu

SEQ ID NO: 3835 - RNA, 17 nt, Mus musculus
ccgcucuuuggggucua

SEQ ID NO: 3836 - RNA, 17 nt, Mus musculus
uuuggggucuagagaug

SEQ ID NO: 3837 - RNA, 17 nt, Mus musculus
uggggucuagagaugag

SEQ ID NO: 3838 - RNA, 17 nt, Mus musculus
cccugggucucuaaaau

SEQ ID NO: 3839 - RNA, 17 nt, Mus musculus
cugggucucuaaaaugg

SEQ ID NO: 3840 - RNA, 17 nt, Mus musculus
gggucucuaaaauggcu

SEQ ID NO: 3841 - RNA, 17 nt, Mus musculus
aaauggcucucuuagaa

SEQ ID NO: 3842 - RNA, 17 nt, Mus musculus
auggcucucuuagaagu

SEQ ID NO: 3843 - RNA, 17 nt, Mus musculus
ggcucucuuagaaguug

SEQ ID NO: 3844 - RNA, 17 nt, Mus musculus
gcucucuuagaaguugu

SEQ ID NO: 3845 - RNA, 17 nt, Mus musculus
uuagaaguuguaugugc

SEQ ID NO: 3846 - RNA, 17 nt, Mus musculus
gaaguuguaugugcaaa

SEQ ID NO: 3847 - RNA, 17 nt, Mus musculus
gugcaaauuauggucug

SEQ ID NO: 3848 - RNA, 17 nt, Mus musculus
ugcaaauuauggucugu

SEQ ID NO: 3849 - RNA, 17 nt, Mus musculus
auuauggucugugugcu

SEQ ID NO: 3850 - RNA, 17 nt, Mus musculus
ugugugcuuaggucgug

SEQ ID NO: 3851 - RNA, 17 nt, Mus musculus
gugugcuuaggucgugc

SEQ ID NO: 3852 - RNA, 17 nt, Mus musculus
gcuuaggucgugcacac

SEQ ID NO: 3853 - RNA, 17 nt, Mus musculus
gagccggucacagcugg

SEQ ID NO: 3854 - RNA, 17 nt, Mus musculus
cgaugaauagcugcuuu

SEQ ID NO: 3855 - RNA, 17 nt, Mus musculus
uagcugcuuugggagag

SEQ ID NO: 3856 - RNA, 17 nt, Mus musculus
agcugcuuugggagagc

SEQ ID NO: 3857 - RNA, 17 nt, Mus musculus
agcaugcuagccacuua

SEQ ID NO: 3858 - RNA, 17 nt, Mus musculus
uagccacuuaauucucu

SEQ ID NO: 3859 - RNA, 17 nt, Mus musculus
agccacuuaauucucug

SEQ ID NO: 3860 - RNA, 17 nt, Mus musculus
cacuuaauucucugacc

SEQ ID NO: 3861 - RNA, 17 nt, Mus musculus
acuuaauucucugaccg

SEQ ID NO: 3862 - RNA, 17 nt, Mus musculus
uuaauucucugaccggg

SEQ ID NO: 3863 - RNA, 17 nt, Mus musculus
gccagcaucauggguac

SEQ ID NO: 3864 - RNA, 17 nt, Mus musculus
ucauggguaccugcucc

SEQ ID NO: 3865 - RNA, 17 nt, Mus musculus
uaccugcuccccugugu

SEQ ID NO: 3866 - RNA, 17 nt, Mus musculus
cccuguguaccccaucc

SEQ ID NO: 3867 - RNA, 17 nt, Mus musculus
uaccccauccuuaaggu

SEQ ID NO: 3868 - RNA, 17 nt, Mus musculus
cccauccuuaagguuuu

SEQ ID NO: 3869 - RNA, 17 nt, Mus musculus
ccauccuuaagguuuuc

SEQ ID NO: 3870 - RNA, 17 nt, Mus musculus
cuuaagguuuucugucu

SEQ ID NO: 3871 - RNA, 17 nt, Mus musculus
uuaagguuuucugucug

SEQ ID NO: 3872 - RNA, 17 nt, Mus musculus
uaagguuuucugucuga

SEQ ID NO: 3873 - RNA, 17 nt, Mus musculus
aagguuuucugucugau

SEQ ID NO: 3874 - RNA, 17 nt, Mus musculus
uuuucugucugaugaga

SEQ ID NO: 3875 - RNA, 17 nt, Mus musculus
agugcaauccccacuga

SEQ ID NO: 3876 - RNA, 17 nt, Mus musculus
cuguggcucuuggugca

SEQ ID NO: 3877 - RNA, 17 nt, Mus musculus
guggcucuuggugcacu

SEQ ID NO: 3878 - RNA, 17 nt, Mus musculus
ggugcacucaccagcca

SEQ ID NO: 3879 - RNA, 17 nt, Mus musculus
ccaggacuagacaagua

SEQ ID NO: 3880 - RNA, 17 nt, Mus musculus
agacaaguaggaaaggg

SEQ ID NO: 3881 - RNA, 17 nt, Mus musculus
aaagggcuucuagccac

SEQ ID NO: 3882 - RNA, 17 nt, Mus musculus
aagggcuucuagccaca

SEQ ID NO: 3883 - RNA, 17 nt, Mus musculus
gggcuucuagccacacu

SEQ ID NO: 3884 - RNA, 17 nt, Mus musculus
aagaaaaucagguaggg

SEQ ID NO: 3885 - RNA, 17 nt, Mus musculus
aaucagguagggcuggc

SEQ ID NO: 3886 - RNA, 17 nt, Mus musculus
aaagacaucuuugucca

SEQ ID NO: 3887 - RNA, 17 nt, Mus musculus
agacaucuuuguccauu

SEQ ID NO: 3888 - RNA, 17 nt, Mus musculus
gacaucuuuguccauuc

SEQ ID NO: 3889 - RNA, 17 nt, Mus musculus
aucuuuguccauucgca

SEQ ID NO: 3890 - RNA, 17 nt, Mus musculus
uuguccauucgcaaaag

SEQ ID NO: 3891 - RNA, 17 nt, Mus musculus
uguccauucgcaaaagc

SEQ ID NO: 3892 - RNA, 17 nt, Mus musculus
caaaagcucuugucggc

SEQ ID NO: 3893 - RNA, 17 nt, Mus musculus
aaagcucuugucggcug

SEQ ID NO: 3894 - RNA, 17 nt, Mus musculus
gcucuugucggcugcag

SEQ ID NO: 3895 - RNA, 17 nt, Mus musculus
caguguguaagucaggc

SEQ ID NO: 3896 - RNA, 17 nt, Mus musculus
guguaagucaggcgaug

SEQ ID NO: 3897 - RNA, 17 nt, Mus musculus
cagaggcuaccagagaa

SEQ ID NO: 3898 - RNA, 17 nt, Mus musculus
ccugagguuucucaucc

SEQ ID NO: 3899 - RNA, 17 nt, Mus musculus
cugagguuucucaucca

SEQ ID NO: 3900 - RNA, 17 nt, Mus musculus
ugagguuucucauccag

SEQ ID NO: 3901 - RNA, 17 nt, Mus musculus
agguuucucauccagau

SEQ ID NO: 3902 - RNA, 17 nt, Mus musculus
uuucucauccagauauc

SEQ ID NO: 3903 - RNA, 17 nt, Mus musculus
auccagauauccagcaa

SEQ ID NO: 3904 - RNA, 17 nt, Mus musculus
ccagauauccagcaauu

SEQ ID NO: 3905 - RNA, 17 nt, Mus musculus
ccagcaauuggggggug

SEQ ID NO: 3906 - RNA, 17 nt, Mus musculus
aagaccauagauggucc

SEQ ID NO: 3907 - RNA, 17 nt, Mus musculus
uagaugguccuguauua

SEQ ID NO: 3908 - RNA, 17 nt, Mus musculus
gguccuguauuauuccg

SEQ ID NO: 3909 - RNA, 17 nt, Mus musculus
uccuguauuauuccgau

SEQ ID NO: 3910 - RNA, 17 nt, Mus musculus
ccuguauuauuccgauu

SEQ ID NO: 3911 - RNA, 17 nt, Mus musculus
uguauuauuccgauuuu

SEQ ID NO: 3912 - RNA, 17 nt, Mus musculus
guauuauuccgauuuua

SEQ ID NO: 3913 - RNA, 17 nt, Mus musculus
auuccgauuuuaauaau

SEQ ID NO: 3914 - RNA, 17 nt, Mus musculus
uuccgauuuuaauaauc

SEQ ID NO: 3915 - RNA, 17 nt, Mus musculus
uccgauuuuaauaaucu

SEQ ID NO: 3916 - RNA, 17 nt, Mus musculus
ccgauuuuaauaaucua

SEQ ID NO: 3917 - RNA, 17 nt, Mus musculus
auuuuaauaaucuaauu

SEQ ID NO: 3918 - RNA, 17 nt, Mus musculus
uuaauaaucuaauucgu

SEQ ID NO: 3919 - RNA, 17 nt, Mus musculus
aauaaucuaauucguga

SEQ ID NO: 3920 - RNA, 17 nt, Mus musculus
aaucuaauucgugauca

SEQ ID NO: 3921 - RNA, 17 nt, Mus musculus
aucuaauucgugaucau

SEQ ID NO: 3922 - RNA, 17 nt, Mus musculus
uucgugaucauuaagag

SEQ ID NO: 3923 - RNA, 17 nt, Mus musculus
gugaucauuaagagacu

SEQ ID NO: 3924 - RNA, 17 nt, Mus musculus
ugaucauuaagagacuu

SEQ ID NO: 3925 - RNA, 17 nt, Mus musculus
aagagacuuuaguaaau

SEQ ID NO: 3926 - RNA, 17 nt, Mus musculus
agagacuuuaguaaaug

SEQ ID NO: 3927 - RNA, 17 nt, Mus musculus
gagacuuuaguaaaugu

SEQ ID NO: 3928 - RNA, 17 nt, Mus musculus
acuuuaguaaauguccc

SEQ ID NO: 3929 - RNA, 17 nt, Mus musculus
guaaaugucccuuuucc

SEQ ID NO: 3930 - RNA, 17 nt, Mus musculus
augucccuuuucccaca

SEQ ID NO: 3931 - RNA, 17 nt, Mus musculus
ugucccuuuucccacaa

SEQ ID NO: 3932 - RNA, 17 nt, Mus musculus
gucccuuuucccacaaa

SEQ ID NO: 3933 - RNA, 17 nt, Mus musculus
ucccuuuucccacaaaa

SEQ ID NO: 3934 - RNA, 17 nt, Mus musculus
acaaaaguaaagaaaag

SEQ ID NO: 3935 - RNA, 17 nt, Mus musculus
gaaaagcuaucgggauu

SEQ ID NO: 3936 - RNA, 17 nt, Mus musculus
aaagcuaucgggauucu

SEQ ID NO: 3937 - RNA, 17 nt, Mus musculus
aucgggauucucugguu

SEQ ID NO: 3938 - RNA, 17 nt, Mus musculus
ucgggauucucugguuc

SEQ ID NO: 3939 - RNA, 17 nt, Mus musculus
gggauucucugguucug

SEQ ID NO: 3940 - RNA, 17 nt, Mus musculus
ucucugguucugcuuaa

SEQ ID NO: 3941 - RNA, 17 nt, Mus musculus
cucugguucugcuuaaa

SEQ ID NO: 3942 - RNA, 17 nt, Mus musculus
guucugcuuaaagacuu

SEQ ID NO: 3943 - RNA, 17 nt, Mus musculus
uucugcuuaaagacuua

SEQ ID NO: 3944 - RNA, 17 nt, Mus musculus
uaaagacuuagcuuugg

SEQ ID NO: 3945 - RNA, 17 nt, Mus musculus
aaagacuuagcuuugga

SEQ ID NO: 3946 - RNA, 17 nt, Mus musculus
acuuagcuuuggagccu

SEQ ID NO: 3947 - RNA, 17 nt, Mus musculus
cuuagcuuuggagccua

SEQ ID NO: 3948 - RNA, 17 nt, Mus musculus
uggagccuaugaaaguu

SEQ ID NO: 3949 - RNA, 17 nt, Mus musculus
augaaaguugaucagcc

SEQ ID NO: 3950 - RNA, 18 nt, Mus musculus
auggucagcugcugggac

SEQ ID NO: 3951 - RNA, 18 nt, Mus musculus
gucagcugcugggacacc

SEQ ID NO: 3952 - RNA, 18 nt, Mus musculus
caccgcggucuugccuua

SEQ ID NO: 3953 - RNA, 18 nt, Mus musculus
acgcgcugcucggguguc

SEQ ID NO: 3954 - RNA, 18 nt, Mus musculus
ggugucugcuucucacag

SEQ ID NO: 3955 - RNA, 18 nt, Mus musculus
caggccagacucucuuuc

SEQ ID NO: 3956 - RNA, 18 nt, Mus musculus
ggaggcagcccacucaug

SEQ ID NO: 3957 - RNA, 18 nt, Mus musculus
ggucucugcccacgaccg

SEQ ID NO: 3958 - RNA, 18 nt, Mus musculus
cccaucggccugugggag

SEQ ID NO: 3959 - RNA, 18 nt, Mus musculus
gaagacagcucaucaucc

SEQ ID NO: 3960 - RNA, 18 nt, Mus musculus
auccccugccgggugacg

SEQ ID NO: 3961 - RNA, 18 nt, Mus musculus
uaccccugaugggcaaag

SEQ ID NO: 3962 - RNA, 18 nt, Mus musculus
uaggacugcugaacugcg

SEQ ID NO: 3963 - RNA, 18 nt, Mus musculus
acuaucugacccaucggc

SEQ ID NO: 3964 - RNA, 18 nt, Mus musculus
aucggcagaccaauacaa

SEQ ID NO: 3965 - RNA, 18 nt, Mus musculus
uacgcccgccgagcccag

SEQ ID NO: 3966 - RNA, 18 nt, Mus musculus
ugagacugcuccacgggc

SEQ ID NO: 3967 - RNA, 18 nt, Mus musculus
acgggcagacucuugucc

SEQ ID NO: 3968 - RNA, 18 nt, Mus musculus
ggcagcggauugaccgga

SEQ ID NO: 3969 - RNA, 18 nt, Mus musculus
uacaccugucgcgugaag

SEQ ID NO: 3970 - RNA, 18 nt, Mus musculus
cguuccagucuuucaaca

SEQ ID NO: 3971 - RNA, 18 nt, Mus musculus
ggaagcagccggugcagg

SEQ ID NO: 3972 - RNA, 18 nt, Mus musculus
gaagacgguccuaucggc

SEQ ID NO: 3973 - RNA, 18 nt, Mus musculus
ccuaucggcuguccauga

SEQ ID NO: 3974 - RNA, 18 nt, Mus musculus
aucggcuguccaugaaag

SEQ ID NO: 3975 - RNA, 18 nt, Mus musculus
gaagucugcucgcuauuu

SEQ ID NO: 3976 - RNA, 18 nt, Mus musculus
aaccucagaucuacgaaa

SEQ ID NO: 3977 - RNA, 18 nt, Mus musculus
ucuauccgcugggcagca

SEQ ID NO: 3978 - RNA, 18 nt, Mus musculus
gguggcugacucucagac

SEQ ID NO: 3979 - RNA, 18 nt, Mus musculus
acucucagaccccuggaa

SEQ ID NO: 3980 - RNA, 18 nt, Mus musculus
aucuacagcugccgggcc

SEQ ID NO: 3981 - RNA, 18 nt, Mus musculus
uacagcugccgggccuuc

SEQ ID NO: 3982 - RNA, 18 nt, Mus musculus
ugucacagaugugccgaa

SEQ ID NO: 3983 - RNA, 18 nt, Mus musculus
gaugccagccgaaggaga

SEQ ID NO: 3984 - RNA, 18 nt, Mus musculus
ugaaacuguccugugugg

SEQ ID NO: 3985 - RNA, 18 nt, Mus musculus
cacaccugcuucaaaacc

SEQ ID NO: 3986 - RNA, 18 nt, Mus musculus
cgccucagaucacuuggu

SEQ ID NO: 3987 - RNA, 18 nt, Mus musculus
aagcgcagccuaccucac

SEQ ID NO: 3988 - RNA, 18 nt, Mus musculus
uggagcugaucacgcuca

SEQ ID NO: 3989 - RNA, 18 nt, Mus musculus
ugaagcggucuucuuccg

SEQ ID NO: 3990 - RNA, 18 nt, Mus musculus
aaagacagacuaccuguc

SEQ ID NO: 3991 - RNA, 18 nt, Mus musculus
gugaacggcugcccuaug

SEQ ID NO: 3992 - RNA, 18 nt, Mus musculus
aacggcugcccuaugaug

SEQ ID NO: 3993 - RNA, 18 nt, Mus musculus
cccaccugccggacugug

SEQ ID NO: 3994 - RNA, 18 nt, Mus musculus
ccugccggacuguggcug

SEQ ID NO: 3995 - RNA, 18 nt, Mus musculus
aagcucugaugaccgaac

SEQ ID NO: 3996 - RNA, 18 nt, Mus musculus
ggccucugauggugaucg

SEQ ID NO: 3997 - RNA, 18 nt, Mus musculus
gaaaccuguccaacuacc

SEQ ID NO: 3998 - RNA, 18 nt, Mus musculus
uuauucugucucaacaag

SEQ ID NO: 3999 - RNA, 18 nt, Mus musculus
ggacgcagccuugcauau

SEQ ID NO: 4000 - RNA, 18 nt, Mus musculus
aagccccgccuagacagu

SEQ ID NO: 4001 - RNA, 18 nt, Mus musculus
gucagcagcucaaguguc

SEQ ID NO: 4002 - RNA, 18 nt, Mus musculus
gucaccagcuccagcuuc

SEQ ID NO: 4003 - RNA, 18 nt, Mus musculus
agcuccagcuucccugaa

SEQ ID NO: 4004 - RNA, 18 nt, Mus musculus
ccaagcagccccucacca

SEQ ID NO: 4005 - RNA, 18 nt, Mus musculus
aagaccugauuuccuaca

SEQ ID NO: 4006 - RNA, 18 nt, Mus musculus
uccuacaguuuccaagug

SEQ ID NO: 4007 - RNA, 18 nt, Mus musculus
aguuucuguccuccagaa

SEQ ID NO: 4008 - RNA, 18 nt, Mus musculus
gaacccugauuaugugag

SEQ ID NO: 4009 - RNA, 18 nt, Mus musculus
uucugcagccgccugaag

SEQ ID NO: 4010 - RNA, 18 nt, Mus musculus
ugcagccgccugaaggaa

SEQ ID NO: 4011 - RNA, 18 nt, Mus musculus
gcaugcggaugagaaccc

SEQ ID NO: 4012 - RNA, 18 nt, Mus musculus
ggccccgguuugcugaac

SEQ ID NO: 4013 - RNA, 18 nt, Mus musculus
gugaccugcuucaagcca

SEQ ID NO: 4014 - RNA, 18 nt, Mus musculus
ccauacugacuagaaaca

SEQ ID NO: 4015 - RNA, 18 nt, Mus musculus
aaggacggcuuugcagau

SEQ ID NO: 4016 - RNA, 18 nt, Mus musculus
cuuugcagauccacauuu

SEQ ID NO: 4017 - RNA, 18 nt, Mus musculus
aagcucugaugaugugag

SEQ ID NO: 4018 - RNA, 18 nt, Mus musculus
acuaucagcuggacacua

SEQ ID NO: 4019 - RNA, 18 nt, Mus musculus
gcacucugcugggcuccc

SEQ ID NO: 4020 - RNA, 18 nt, Mus musculus
ugaagcgguucaccugga

SEQ ID NO: 4021 - RNA, 18 nt, Mus musculus
acuuuccgaucugccgag

SEQ ID NO: 4022 - RNA, 18 nt, Mus musculus
ccgaucugccgaggccca

SEQ ID NO: 4023 - RNA, 18 nt, Mus musculus
aggcccagcuucugcuuc

SEQ ID NO: 4024 - RNA, 18 nt, Mus musculus
agcuucugcuucuccagc

SEQ ID NO: 4025 - RNA, 18 nt, Mus musculus
uucuccagcuguggccac

SEQ ID NO: 4026 - RNA, 18 nt, Mus musculus
gaguccugcuguucucca

SEQ ID NO: 4027 - RNA, 18 nt, Mus musculus
uccugcuguucuccaccc

SEQ ID NO: 4028 - RNA, 18 nt, Mus musculus
acccccagacuacaacuc

SEQ ID NO: 4029 - RNA, 18 nt, Mus musculus
ccuccccgcccgccuaaa

SEQ ID NO: 4030 - RNA, 18 nt, Mus musculus
cccgcccgccuaaagcuu

SEQ ID NO: 4031 - RNA, 18 nt, Mus musculus
cucaccagccccgacaac

SEQ ID NO: 4032 - RNA, 18 nt, Mus musculus
acaaccagccccugacag

SEQ ID NO: 4033 - RNA, 18 nt, Mus musculus
cuauuccgcuccacagga

SEQ ID NO: 4034 - RNA, 18 nt, Mus musculus
ggagccagcugcuuuucg

SEQ ID NO: 4035 - RNA, 18 nt, Mus musculus
gccagcugcuuuucguga

SEQ ID NO: 4036 - RNA, 18 nt, Mus musculus
uguugcuguuuugacuaa

SEQ ID NO: 4037 - RNA, 18 nt, Mus musculus
ggcgaccgcccgcccacc

SEQ ID NO: 4038 - RNA, 18 nt, Mus musculus
accgcccgcccaccggcc

SEQ ID NO: 4039 - RNA, 18 nt, Mus musculus
cccugcagcugugggacu

SEQ ID NO: 4040 - RNA, 18 nt, Mus musculus
augcacugaccugcucug

SEQ ID NO: 4041 - RNA, 18 nt, Mus musculus
cugaccugcucugucucu

SEQ ID NO: 4042 - RNA, 18 nt, Mus musculus
cugcucugucucucuuau

SEQ ID NO: 4043 - RNA, 18 nt, Mus musculus
ugcguccguccuguggag

SEQ ID NO: 4044 - RNA, 18 nt, Mus musculus
ggccuccgcuguuucggg

SEQ ID NO: 4045 - RNA, 18 nt, Mus musculus
cuccgcuguuucgggccc

SEQ ID NO: 4046 - RNA, 18 nt, Mus musculus
gucuucuguugucuguuu

SEQ ID NO: 4047 - RNA, 18 nt, Mus musculus
guugucuguuuaccaucc

SEQ ID NO: 4048 - RNA, 18 nt, Mus musculus
aucaucaguuccucuagu

SEQ ID NO: 4049 - RNA, 18 nt, Mus musculus
caggccugaccuucgcau

SEQ ID NO: 4050 - RNA, 18 nt, Mus musculus
gcauacugcucacgggga

SEQ ID NO: 4051 - RNA, 18 nt, Mus musculus
ugguccaguuuggccuag

SEQ ID NO: 4052 - RNA, 18 nt, Mus musculus
gccuacugaugggcucaa

SEQ ID NO: 4053 - RNA, 18 nt, Mus musculus
uuauccuguuuuauauau

SEQ ID NO: 4054 - RNA, 18 nt, Mus musculus
caaggcagucugagagga

SEQ ID NO: 4055 - RNA, 18 nt, Mus musculus
aguaucagcccauauuua

SEQ ID NO: 4056 - RNA, 18 nt, Mus musculus
uucaucuguuucauaccu

SEQ ID NO: 4057 - RNA, 18 nt, Mus musculus
ggugcccgcucuuugggg

SEQ ID NO: 4058 - RNA, 18 nt, Mus musculus
cacaccugccggagccgg

SEQ ID NO: 4059 - RNA, 18 nt, Mus musculus
ggucacagcugggcagac

SEQ ID NO: 4060 - RNA, 18 nt, Mus musculus
cugggcagacgaugaaua

SEQ ID NO: 4061 - RNA, 18 nt, Mus musculus
aauagcugcuuugggaga

SEQ ID NO: 4062 - RNA, 18 nt, Mus musculus
auucucugaccgggccag

SEQ ID NO: 4063 - RNA, 18 nt, Mus musculus
gguaccugcuccccugug

SEQ ID NO: 4064 - RNA, 18 nt, Mus musculus
guuuucugucugaugaga

SEQ ID NO: 4065 - RNA, 18 nt, Mus musculus
ucugucugaugagacugg

SEQ ID NO: 4066 - RNA, 18 nt, Mus musculus
ugagacagccugcagccc

SEQ ID NO: 4067 - RNA, 18 nt, Mus musculus
gccugcagcccacugugg

SEQ ID NO: 4068 - RNA, 18 nt, Mus musculus
cuugucggcugcagugug

SEQ ID NO: 4069 - RNA, 18 nt, Mus musculus
agaaacggaugagaacag

SEQ ID NO: 4070 - RNA, 18 nt, Mus musculus
aacagcagccugagguuu

SEQ ID NO: 4071 - RNA, 18 nt, Mus musculus
uuauuccgauuuuaauaa

SEQ ID NO: 4072 - RNA, 18 nt, Mus musculus
ugguucugcuuaaagacu

SEQ ID NO: 4073 - RNA, 15 nt, Homo sapiens
ccgggauauuuauaa

SEQ ID NO: 4074 - RNA, 15 nt, Homo sapiens
aauguauacacaggg

SEQ ID NO: 4075 - RNA, 15 nt, Homo sapiens
ugcaaauauggaaau

SEQ ID NO: 4076 - RNA, 15 nt, Homo sapiens
cucccuuaugaugcc

SEQ ID NO: 4077 - RNA, 15 nt, Homo sapiens
guugaauacugcaaa

SEQ ID NO: 4078 - RNA, 15 nt, Homo sapiens
uaugguuaaaagaug

SEQ ID NO: 4079 - RNA, 15 nt, Homo sapiens
gggauauuuauaaga

SEQ ID NO: 4080 - RNA, 15 nt, Homo sapiens
ggauauuuauaagaa

SEQ ID NO: 4081 - RNA, 15 nt, Homo sapiens
acgugguuaaccugc

SEQ ID NO: 4082 - RNA, 15 nt, Homo sapiens
uauuucuagucauga

SEQ ID NO: 4083 - RNA, 15 nt, Homo sapiens
caauaauagaaggaa

SEQ ID NO: 4084 - RNA, 15 nt, Homo sapiens
gagacuuaaacuggg

SEQ ID NO: 4085 - RNA, 15 nt, Homo sapiens
gaugacuaccagggc

SEQ ID NO: 4086 - RNA, 15 nt, Homo sapiens
uuaauguagaaagaa

SEQ ID NO: 4087 - RNA, 15 nt, Homo sapiens
gccauuuaugacaaa

SEQ ID NO: 4088 - RNA, 15 nt, Homo sapiens
gucaaauuacuuaga

SEQ ID NO: 4089 - RNA, 15 nt, Homo sapiens
auaaaguugggacug

SEQ ID NO: 4090 - RNA, 15 nt, Homo sapiens
acuugguuuaaaaac

SEQ ID NO: 4091 - RNA, 15 nt, Homo sapiens
aagugguucaagcau

SEQ ID NO: 4092 - RNA, 15 nt, Homo sapiens
uucuccuuagguggg

SEQ ID NO: 4093 - RNA, 15 nt, Homo sapiens
ucuccuuaggugggu

SEQ ID NO: 4094 - RNA, 15 nt, Homo sapiens
guacucuacuccuga

SEQ ID NO: 4095 - RNA, 15 nt, Homo sapiens
agcaccuugguugug

SEQ ID NO: 4096 - RNA, 15 nt, Homo sapiens
ggcaaaucacuugga

SEQ ID NO: 4097 - RNA, 15 nt, Homo sapiens
caagcaucagcauuu

SEQ ID NO: 4098 - RNA, 15 nt, Homo sapiens
gagagcuccugagua

SEQ ID NO: 4099 - RNA, 15 nt, Homo sapiens
aaggccucgcucaag

SEQ ID NO: 4100 - RNA, 15 nt, Homo sapiens
ucuccauaucaaaac

SEQ ID NO: 4101 - RNA, 15 nt, Homo sapiens
auguauuuuguauac

SEQ ID NO: 4102 - RNA, 15 nt, Homo sapiens
cuagaauuucuggaa

SEQ ID NO: 4103 - RNA, 15 nt, Homo sapiens
cucucuucuggcucc

SEQ ID NO: 4104 - RNA, 15 nt, Homo sapiens
cuguacuccacccca

SEQ ID NO: 4105 - RNA, 15 nt, Homo sapiens
acaugguuugguccu

SEQ ID NO: 4106 - RNA, 15 nt, Homo sapiens
auggucuuugccuga

SEQ ID NO: 4107 - RNA, 15 nt, Homo sapiens
gcaccauaccuccug

SEQ ID NO: 4108 - RNA, 15 nt, Homo sapiens
gggcuuuuggaaaag

SEQ ID NO: 4109 - RNA, 15 nt, Homo sapiens
ccagacuacaacucg

SEQ ID NO: 4110 - RNA, 15 nt, Homo sapiens
guuuucuccauauca

SEQ ID NO: 4111 - RNA, 15 nt, Homo sapiens
agaauguaugccucu

SEQ ID NO: 4112 - RNA, 15 nt, Homo sapiens
auucccuagugagcc

SEQ ID NO: 4113 - RNA, 15 nt, Homo sapiens
uguuguuccucuucu

SEQ ID NO: 4114 - RNA, 15 nt, Homo sapiens
gcuuccuuuuaucca

SEQ ID NO: 4115 - RNA, 15 nt, Homo sapiens
uauauauucucugcu

SEQ ID NO: 4116 - RNA, 15 nt, Homo sapiens
aguguauccacaggg

SEQ ID NO: 4117 - RNA, 15 nt, Homo sapiens
ugcaaauuuggaaac

SEQ ID NO: 4118 - RNA, 15 nt, Homo sapiens
cugccuuaugaugcc

SEQ ID NO: 4119 - RNA, 15 nt, Homo sapiens
guggaauucugcaaa

SEQ ID NO: 4120 - RNA, 15 nt, Homo sapiens
ugugguuuaaagaua

SEQ ID NO: 4121 - RNA, 15 nt, Homo sapiens
gggauauuuauaaag

SEQ ID NO: 4122 - RNA, 15 nt, Homo sapiens
ggauauuuauaaaga

SEQ ID NO: 4123 - RNA, 15 nt, Homo sapiens
auguggucaaccuuc

SEQ ID NO: 4124 - RNA, 15 nt, Homo sapiens
uacuucuugucauca

SEQ ID NO: 4125 - RNA, 15 nt, Homo sapiens
cucuaauugaaggaa

SEQ ID NO: 4126 - RNA, 15 nt, Homo sapiens
uugacuucaacuggg

SEQ ID NO: 4127 - RNA, 15 nt, Homo sapiens
gaggacuuccaggga

SEQ ID NO: 4128 - RNA, 15 nt, Homo sapiens
aaaauguugaaagaa

SEQ ID NO: 4129 - RNA, 15 nt, Homo sapiens
acaauuuuugacaga

SEQ ID NO: 4130 - RNA, 15 nt, Homo sapiens
uucaaauuacuugca

SEQ ID NO: 4131 - RNA, 15 nt, Homo sapiens
acaaagucgggagag

SEQ ID NO: 4132 - RNA, 15 nt, Homo sapiens
aaaugguauaaaaau

SEQ ID NO: 4133 - RNA, 15 nt, Homo sapiens
acaugguacaagcuu

SEQ ID NO: 4134 - RNA, 15 nt, Homo sapiens
uuuuccuuaggugcu

SEQ ID NO: 4135 - RNA, 15 nt, Homo sapiens
uuuccuuaggugcuu

SEQ ID NO: 4136 - RNA, 15 nt, Homo sapiens
gagcucuccuccugu

SEQ ID NO: 4137 - RNA, 15 nt, Homo sapiens
aguaccuugguuacc

SEQ ID NO: 4138 - RNA, 15 nt, Homo sapiens
gaagcaucagcauaa

SEQ ID NO: 4139 - RNA, 15 nt, Homo sapiens
ggaagcuccugaaga

SEQ ID NO: 4140 - RNA, 15 nt, Homo sapiens
ucugccuugcucaag

SEQ ID NO: 4141 - RNA, 15 nt, Homo sapiens
gguccauuucaaauc

SEQ ID NO: 4142 - RNA, 15 nt, Homo sapiens
gucuauuauguacau

SEQ ID NO: 4143 - RNA, 15 nt, Homo sapiens
auggaaucucuggug

SEQ ID NO: 4144 - RNA, 15 nt, Homo sapiens
uguucuucuggcuac

SEQ ID NO: 4145 - RNA, 15 nt, Homo sapiens
uuauacuacaccaga

SEQ ID NO: 4146 - RNA, 15 nt, Homo sapiens
cagugguaugguucu

SEQ ID NO: 4147 - RNA, 15 nt, Homo sapiens
acggucuaugccauu

SEQ ID NO: 4148 - RNA, 15 nt, Homo sapiens
augccauuccucccc

SEQ ID NO: 4149 - RNA, 15 nt, Homo sapiens
uugcuuuuggaagug

SEQ ID NO: 4150 - RNA, 15 nt, Homo sapiens
auugacuucaacugg

SEQ ID NO: 4151 - RNA, 15 nt, Homo sapiens
ugcuucuccauaucc

SEQ ID NO: 4152 - RNA, 15 nt, Homo sapiens
acuaugucugccuug

SEQ ID NO: 4153 - RNA, 15 nt, Homo sapiens
auacccuugugaaga

SEQ ID NO: 4154 - RNA, 15 nt, Homo sapiens
uaguguuucucuuga

SEQ ID NO: 4155 - RNA, 15 nt, Homo sapiens
auauccucuuaucgg

SEQ ID NO: 4156 - RNA, 15 nt, Homo sapiens
gaaauauccucuuau

SEQ ID NO: 4157 - RNA, 38 nt, Artificial Sequence
  Description of Artificial Sequence:  Enzymatic Nucleic Acid
  misc_feature (18)..(25): n stands for any nucleotide and can be optionally absent
gccgagagcugaugaggnnnnnnnnccgaaaguguccg

SEQ ID NO: 4158 - RNA, 38 nt, Artificial Sequence
  Description of Artificial Sequence:  Enzymatic Nucleic Acid
  misc_feature (18)..(25): n stands for any nucleotide and can be optionally absent
ggagccgacugaugaggnnnnnnnnccgaaaggagugu

SEQ ID NO: 4159 - RNA, 38 nt, Artificial Sequence
  Description of Artificial Sequence:  Enzymatic Nucleic Acid
  misc_feature (18)..(25): n stands for any nucleotide and can be optionally absent
gaggagcccugaugaggnnnnnnnnccgaaagaggagu

SEQ ID NO: 4160 - RNA, 38 nt, Artificial Sequence
  Description of Artificial Sequence:  Enzymatic Nucleic Acid
  misc_feature (18)..(25): n stands for any nucleotide and can be optionally absent
ccggggagcugaugaggnnnnnnnnccgaaagccgaga

SEQ ID NO: 4161 - RNA, 38 nt, Artificial Sequence
  Description of Artificial Sequence:  Enzymatic Nucleic Acid
  misc_feature (18)..(25): n stands for any nucleotide and can be optionally absent
cugccgggcugaugaggnnnnnnnnccgaaaggagccg

SEQ ID NO: 4162 - RNA, 38 nt, Artificial Sequence
  Description of Artificial Sequence:  Enzymatic Nucleic Acid
  misc_feature (18)..(25): n stands for any nucleotide and can be optionally absent
cccgcucccugaugaggnnnnnnnnccgaaagccgccg

SEQ ID NO: 4163 - RNA, 38 nt, Artificial Sequence
  Description of Artificial Sequence:  Enzymatic Nucleic Acid
  misc_feature (18)..(25): n stands for any nucleotide and can be optionally absent
gagccccgcugaugaggnnnnnnnnccgaaagcccgcu

SEQ ID NO: 4164 - RNA, 38 nt, Artificial Sequence
  Description of Artificial Sequence:  Enzymatic Nucleic Acid
  misc_feature (18)..(25): n stands for any nucleotide and can be optionally absent
cugcaccccugaugaggnnnnnnnnccgaaagccccgg

SEQ ID NO: 4165 - RNA, 38 nt, Artificial Sequence
  Description of Artificial Sequence:  Enzymatic Nucleic Acid
  misc_feature (18)..(25): n stands for any nucleotide and can be optionally absent
ccccgggucugaugaggnnnnnnnnccgaaauccucgc

SEQ ID NO: 4166 - RNA, 38 nt, Artificial Sequence
  Description of Artificial Sequence:  Enzymatic Nucleic Acid
  misc_feature (18)..(25): n stands for any nucleotide and can be optionally absent
uccccgggcugaugaggnnnnnnnnccgaaaauccucg

SEQ ID NO: 4167 - RNA, 38 nt, Artificial Sequence
  Description of Artificial Sequence:  Enzymatic Nucleic Acid
  misc_feature (18)..(25): n stands for any nucleotide and can be optionally absent
caggagaccugaugaggnnnnnnnnccgaaaccacuuc

SEQ ID NO: 4168 - RNA, 38 nt, Artificial Sequence
  Description of Artificial Sequence:  Enzymatic Nucleic Acid
  misc_feature (18)..(25): n stands for any nucleotide and can be optionally absent
agccaggacugaugaggnnnnnnnnccgaaacaaccac

SEQ ID NO: 4169 - RNA, 38 nt, Artificial Sequence
  Description of Artificial Sequence:  Enzymatic Nucleic Acid
  misc_feature (18)..(25): n stands for any nucleotide and can be optionally absent
ccagccagcugaugaggnnnnnnnnccgaaagacaacc

SEQ ID NO: 4170 - RNA, 38 nt, Artificial Sequence
  Description of Artificial Sequence:  Enzymatic Nucleic Acid
  misc_feature (18)..(25): n stands for any nucleotide and can be optionally absent
cgcgcccucugaugaggnnnnnnnnccgaaagcgcccg

SEQ ID NO: 4171 - RNA, 38 nt, Artificial Sequence
  Description of Artificial Sequence:  Enzymatic Nucleic Acid
  misc_feature (18)..(25): n stands for any nucleotide and can be optionally absent
ggccgccacugaugaggnnnnnnnnccgaaaguccguc

SEQ ID NO: 4172 - RNA, 38 nt, Artificial Sequence
  Description of Artificial Sequence:  Enzymatic Nucleic Acid
  misc_feature (18)..(25): n stands for any nucleotide and can be optionally absent
cggccaaccugaugaggnnnnnnnnccgaaacccggcc

SEQ ID NO: 4173 - RNA, 38 nt, Artificial Sequence
  Description of Artificial Sequence:  Enzymatic Nucleic Acid
  misc_feature (18)..(25): n stands for any nucleotide and can be optionally absent
ccccggcccugaugaggnnnnnnnnccgaaacgacccg

SEQ ID NO: 4174 - RNA, 38 nt, Artificial Sequence
  Description of Artificial Sequence:  Enzymatic Nucleic Acid
  misc_feature (18)..(25): n stands for any nucleotide and can be optionally absent
gugagcgccugaugaggnnnnnnnnccgaaacgcggcc

SEQ ID NO: 4175 - RNA, 38 nt, Artificial Sequence
  Description of Artificial Sequence:  Enzymatic Nucleic Acid
  misc_feature (18)..(25): n stands for any nucleotide and can be optionally absent
accauggucugaugaggnnnnnnnnccgaaagcgcgac

SEQ ID NO: 4176 - RNA, 38 nt, Artificial Sequence
  Description of Artificial Sequence:  Enzymatic Nucleic Acid
  misc_feature (18)..(25): n stands for any nucleotide and can be optionally absent
caguagcucugaugaggnnnnnnnnccgaaaccauggu

SEQ ID NO: 4177 - RNA, 38 nt, Artificial Sequence
  Description of Artificial Sequence:  Enzymatic Nucleic Acid
  misc_feature (18)..(25): n stands for any nucleotide and can be optionally absent
ugucccagcugaugaggnnnnnnnnccgaaagcugacc

SEQ ID NO: 4178 - RNA, 38 nt, Artificial Sequence
  Description of Artificial Sequence:  Enzymatic Nucleic Acid
  misc_feature (18)..(25): n stands for any nucleotide and can be optionally absent
cacagcagcugaugaggnnnnnnnnccgaaaccccggu

SEQ ID NO: 4179 - RNA, 38 nt, Artificial Sequence
  Description of Artificial Sequence:  Enzymatic Nucleic Acid
  misc_feature (18)..(25): n stands for any nucleotide and can be optionally absent
agacagcucugaugaggnnnnnnnnccgaaagcagcgc

SEQ ID NO: 4180 - RNA, 38 nt, Artificial Sequence
  Description of Artificial Sequence:  Enzymatic Nucleic Acid
  misc_feature (18)..(25): n stands for any nucleotide and can be optionally absent
gagaagcacugaugaggnnnnnnnnccgaaacagcuga

SEQ ID NO: 4181 - RNA, 38 nt, Artificial Sequence
  Description of Artificial Sequence:  Enzymatic Nucleic Acid
  misc_feature (18)..(25): n stands for any nucleotide and can be optionally absent
ccugugagcugaugaggnnnnnnnnccgaaagcagaca

SEQ ID NO: 4182 - RNA, 38 nt, Artificial Sequence
  Description of Artificial Sequence:  Enzymatic Nucleic Acid
  misc_feature (18)..(25): n stands for any nucleotide and can be optionally absent
uccugugacugaugaggnnnnnnnnccgaaaagcagac

SEQ ID NO: 4183 - RNA, 38 nt, Artificial Sequence
  Description of Artificial Sequence:  Enzymatic Nucleic Acid
  misc_feature (18)..(25): n stands for any nucleotide and can be optionally absent
gauccugucugaugaggnnnnnnnnccgaaagaagcag

SEQ ID NO: 4184 - RNA, 38 nt, Artificial Sequence
  Description of Artificial Sequence:  Enzymatic Nucleic Acid
  misc_feature (18)..(25): n stands for any nucleotide and can be optionally absent
cugaacuacugaugaggnnnnnnnnccgaaauccugug

SEQ ID NO: 4185 - RNA, 38 nt, Artificial Sequence
  Description of Artificial Sequence:  Enzymatic Nucleic Acid
  misc_feature (18)..(25): n stands for any nucleotide and can be optionally absent
accugaaccugaugaggnnnnnnnnccgaaagauccug

SEQ ID NO: 4186 - RNA, 38 nt, Artificial Sequence
  Description of Artificial Sequence:  Enzymatic Nucleic Acid
  misc_feature (18)..(25): n stands for any nucleotide and can be optionally absent
ugaaccugcugaugaggnnnnnnnnccgaaacuagauc

SEQ ID NO: 4187 - RNA, 38 nt, Artificial Sequence
  Description of Artificial Sequence:  Enzymatic Nucleic Acid
  misc_feature (18)..(25): n stands for any nucleotide and can be optionally absent
uugaaccucugaugaggnnnnnnnnccgaaaacuagau

SEQ ID NO: 4188 - RNA, 38 nt, Artificial Sequence
  Description of Artificial Sequence:  Enzymatic Nucleic Acid
  misc_feature (18)..(25): n stands for any nucleotide and can be optionally absent
uaauuuugcugaugaggnnnnnnnnccgaaaccugaac

SEQ ID NO: 4189 - RNA, 38 nt, Artificial Sequence
  Description of Artificial Sequence:  Enzymatic Nucleic Acid
  misc_feature (18)..(25): n stands for any nucleotide and can be optionally absent
uuaauuuucugaugaggnnnnnnnnccgaaaaccugaa

SEQ ID NO: 4190 - RNA, 38 nt, Artificial Sequence
  Description of Artificial Sequence:  Enzymatic Nucleic Acid
  misc_feature (18)..(25): n stands for any nucleotide and can be optionally absent
gaucuuuucugaugaggnnnnnnnnccgaaauuuugaa

SEQ ID NO: 4191 - RNA, 38 nt, Artificial Sequence
  Description of Artificial Sequence:  Enzymatic Nucleic Acid
  misc_feature (18)..(25): n stands for any nucleotide and can be optionally absent
ggaucuuucugaugaggnnnnnnnnccgaaaauuuuga

SEQ ID NO: 4192 - RNA, 38 nt, Artificial Sequence
  Description of Artificial Sequence:  Enzymatic Nucleic Acid
  misc_feature (18)..(25): n stands for any nucleotide and can be optionally absent
caguucagcugaugaggnnnnnnnnccgaaaucuuuua

SEQ ID NO: 4193 - RNA, 38 nt, Artificial Sequence
  Description of Artificial Sequence:  Enzymatic Nucleic Acid
  misc_feature (18)..(25): n stands for any nucleotide and can be optionally absent
gccuuuuacugaugaggnnnnnnnnccgaaacucaguu

SEQ ID NO: 4194 - RNA, 38 nt, Artificial Sequence
  Description of Artificial Sequence:  Enzymatic Nucleic Acid
  misc_feature (18)..(25): n stands for any nucleotide and can be optionally absent
ugccuuuucugaugaggnnnnnnnnccgaaaacucagu

SEQ ID NO: 4195 - RNA, 38 nt, Artificial Sequence
  Description of Artificial Sequence:  Enzymatic Nucleic Acid
  misc_feature (18)..(25): n stands for any nucleotide and can be optionally absent
gugccuuucugaugaggnnnnnnnnccgaaaaacucag

SEQ ID NO: 4196 - RNA, 38 nt, Artificial Sequence
  Description of Artificial Sequence:  Enzymatic Nucleic Acid
  misc_feature (18)..(25): n stands for any nucleotide and can be optionally absent
gcuugcaucugaugaggnnnnnnnnccgaaaugugcug

SEQ ID NO: 4197 - RNA, 38 nt, Artificial Sequence
  Description of Artificial Sequence:  Enzymatic Nucleic Acid
  misc_feature (18)..(25): n stands for any nucleotide and can be optionally absent
gcauuggacugaugaggnnnnnnnnccgaaaugcagug

SEQ ID NO: 4198 - RNA, 38 nt, Artificial Sequence
  Description of Artificial Sequence:  Enzymatic Nucleic Acid
  misc_feature (18)..(25): n stands for any nucleotide and can be optionally absent
cugcauugcugaugaggnnnnnnnnccgaaagaugcag

SEQ ID NO: 4199 - RNA, 38 nt, Artificial Sequence
  Description of Artificial Sequence:  Enzymatic Nucleic Acid
  misc_feature (18)..(25): n stands for any nucleotide and can be optionally absent
agaccauucugaugaggnnnnnnnnccgaaaugggcug

SEQ ID NO: 4200 - RNA, 38 nt, Artificial Sequence
  Description of Artificial Sequence:  Enzymatic Nucleic Acid
  misc_feature (18)..(25): n stands for any nucleotide and can be optionally absent
caggcaaacugaugaggnnnnnnnnccgaaaccauuua

SEQ ID NO: 4201 - RNA, 38 nt, Artificial Sequence
  Description of Artificial Sequence:  Enzymatic Nucleic Acid
  misc_feature (18)..(25): n stands for any nucleotide and can be optionally absent
uucaggcacugaugaggnnnnnnnnccgaaagaccauu

SEQ ID NO: 4202 - RNA, 38 nt, Artificial Sequence
  Description of Artificial Sequence:  Enzymatic Nucleic Acid
  misc_feature (18)..(25): n stands for any nucleotide and can be optionally absent
uuucaggccugaugaggnnnnnnnnccgaaaagaccau

SEQ ID NO: 4203 - RNA, 38 nt, Artificial Sequence
  Description of Artificial Sequence:  Enzymatic Nucleic Acid
  misc_feature (18)..(25): n stands for any nucleotide and can be optionally absent
gcuuuccucugaugaggnnnnnnnnccgaaacucacca

SEQ ID NO: 4204 - RNA, 38 nt, Artificial Sequence
  Description of Artificial Sequence:  Enzymatic Nucleic Acid
  misc_feature (18)..(25): n stands for any nucleotide and can be optionally absent
gauuuagucugaugaggnnnnnnnnccgaaaugcucag

SEQ ID NO: 4205 - RNA, 38 nt, Artificial Sequence
  Description of Artificial Sequence:  Enzymatic Nucleic Acid
  misc_feature (18)..(25): n stands for any nucleotide and can be optionally absent
ggcagauucugaugaggnnnnnnnnccgaaaguuaugc

SEQ ID NO: 4206 - RNA, 38 nt, Artificial Sequence
  Description of Artificial Sequence:  Enzymatic Nucleic Acid
  misc_feature (18)..(25): n stands for any nucleotide and can be optionally absent
cacaggcacugaugaggnnnnnnnnccgaaauuuaguu

SEQ ID NO: 4207 - RNA, 38 nt, Artificial Sequence
  Description of Artificial Sequence:  Enzymatic Nucleic Acid
  misc_feature (18)..(25): n stands for any nucleotide and can be optionally absent
uacugcagcugaugaggnnnnnnnnccgaaauuguuug

SEQ ID NO: 4208 - RNA, 38 nt, Artificial Sequence
  Description of Artificial Sequence:  Enzymatic Nucleic Acid
  misc_feature (18)..(25): n stands for any nucleotide and can be optionally absent
guacugcacugaugaggnnnnnnnnccgaaaauuguuu

SEQ ID NO: 4209 - RNA, 38 nt, Artificial Sequence
  Description of Artificial Sequence:  Enzymatic Nucleic Acid
  misc_feature (18)..(25): n stands for any nucleotide and can be optionally absent
gguuaaagcugaugaggnnnnnnnnccgaaacugcaga

SEQ ID NO: 4210 - RNA, 38 nt, Artificial Sequence
  Description of Artificial Sequence:  Enzymatic Nucleic Acid
  misc_feature (18)..(25): n stands for any nucleotide and can be optionally absent
caagguuacugaugaggnnnnnnnnccgaaaguacugc

SEQ ID NO: 4211 - RNA, 38 nt, Artificial Sequence
  Description of Artificial Sequence:  Enzymatic Nucleic Acid
  misc_feature (18)..(25): n stands for any nucleotide and can be optionally absent
ucaagguucugaugaggnnnnnnnnccgaaaaguacug

SEQ ID NO: 4212 - RNA, 38 nt, Artificial Sequence
  Description of Artificial Sequence:  Enzymatic Nucleic Acid
  misc_feature (18)..(25): n stands for any nucleotide and can be optionally absent
uucaaggucugaugaggnnnnnnnnccgaaaaaguacu

SEQ ID NO: 4213 - RNA, 38 nt, Artificial Sequence
  Description of Artificial Sequence:  Enzymatic Nucleic Acid
  misc_feature (18)..(25): n stands for any nucleotide and can be optionally absent
cuguguuccugaugaggnnnnnnnnccgaaagguuaaa

SEQ ID NO: 4214 - RNA, 38 nt, Artificial Sequence
  Description of Artificial Sequence:  Enzymatic Nucleic Acid
  misc_feature (18)..(25): n stands for any nucleotide and can be optionally absent
guuugcuucugaugaggnnnnnnnnccgaaagcugugu

SEQ ID NO: 4215 - RNA, 38 nt, Artificial Sequence
  Description of Artificial Sequence:  Enzymatic Nucleic Acid
  misc_feature (18)..(25): n stands for any nucleotide and can be optionally absent
agcuguagcugaugaggnnnnnnnnccgaaagccagug

SEQ ID NO: 4216 - RNA, 38 nt, Artificial Sequence
  Description of Artificial Sequence:  Enzymatic Nucleic Acid
  misc_feature (18)..(25): n stands for any nucleotide and can be optionally absent
cagcuguacugaugaggnnnnnnnnccgaaaagccagu

SEQ ID NO: 4217 - RNA, 38 nt, Artificial Sequence
  Description of Artificial Sequence:  Enzymatic Nucleic Acid
  misc_feature (18)..(25): n stands for any nucleotide and can be optionally absent
ugcagcugcugaugaggnnnnnnnnccgaaagaagcca

SEQ ID NO: 4218 - RNA, 38 nt, Artificial Sequence
  Description of Artificial Sequence:  Enzymatic Nucleic Acid
  misc_feature (18)..(25): n stands for any nucleotide and can be optionally absent
cagcuagacugaugaggnnnnnnnnccgaaauuugcag

SEQ ID NO: 4219 - RNA, 38 nt, Artificial Sequence
  Description of Artificial Sequence:  Enzymatic Nucleic Acid
  misc_feature (18)..(25): n stands for any nucleotide and can be optionally absent
uacagcuacugaugaggnnnnnnnnccgaaauauuugc

SEQ ID NO: 4220 - RNA, 38 nt, Artificial Sequence
  Description of Artificial Sequence:  Enzymatic Nucleic Acid
  misc_feature (18)..(25): n stands for any nucleotide and can be optionally absent
gguacagccugaugaggnnnnnnnnccgaaagauauuu

SEQ ID NO: 4221 - RNA, 38 nt, Artificial Sequence
  Description of Artificial Sequence:  Enzymatic Nucleic Acid
  misc_feature (18)..(25): n stands for any nucleotide and can be optionally absent
gaaguaggcugaugaggnnnnnnnnccgaaacagcuag

SEQ ID NO: 4222 - RNA, 38 nt, Artificial Sequence
  Description of Artificial Sequence:  Enzymatic Nucleic Acid
  misc_feature (18)..(25): n stands for any nucleotide and can be optionally absent
cuuugaagcugaugaggnnnnnnnnccgaaagguacag

SEQ ID NO: 4223 - RNA, 38 nt, Artificial Sequence
  Description of Artificial Sequence:  Enzymatic Nucleic Acid
  misc_feature (18)..(25): n stands for any nucleotide and can be optionally absent
cuucuuugcugaugaggnnnnnnnnccgaaaguaggua

SEQ ID NO: 4224 - RNA, 38 nt, Artificial Sequence
  Description of Artificial Sequence:  Enzymatic Nucleic Acid
  misc_feature (18)..(25): n stands for any nucleotide and can be optionally absent
ucuucuuucugaugaggnnnnnnnnccgaaaaguaggu

SEQ ID NO: 4225 - RNA, 38 nt, Artificial Sequence
  Description of Artificial Sequence:  Enzymatic Nucleic Acid
  misc_feature (18)..(25): n stands for any nucleotide and can be optionally absent
agauugcacugaugaggnnnnnnnnccgaaauucuguu

SEQ ID NO: 4226 - RNA, 38 nt, Artificial Sequence
  Description of Artificial Sequence:  Enzymatic Nucleic Acid
  misc_feature (18)..(25): n stands for any nucleotide and can be optionally absent
aauauauacugaugaggnnnnnnnnccgaaauugcaga

SEQ ID NO: 4227 - RNA, 38 nt, Artificial Sequence
  Description of Artificial Sequence:  Enzymatic Nucleic Acid
  misc_feature (18)..(25): n stands for any nucleotide and can be optionally absent
uaaauauacugaugaggnnnnnnnnccgaaagauugca

SEQ ID NO: 4228 - RNA, 38 nt, Artificial Sequence
  Description of Artificial Sequence:  Enzymatic Nucleic Acid
  misc_feature (18)..(25): n stands for any nucleotide and can be optionally absent
aauaaauacugaugaggnnnnnnnnccgaaauagauug

SEQ ID NO: 4229 - RNA, 38 nt, Artificial Sequence
  Description of Artificial Sequence:  Enzymatic Nucleic Acid
  misc_feature (18)..(25): n stands for any nucleotide and can be optionally absent
cuaauaaacugaugaggnnnnnnnnccgaaauauagau

SEQ ID NO: 4230 - RNA, 38 nt, Artificial Sequence
  Description of Artificial Sequence:  Enzymatic Nucleic Acid
  misc_feature (18)..(25): n stands for any nucleotide and can be optionally absent
cacuaauacugaugaggnnnnnnnnccgaaauauauag

SEQ ID NO: 4231 - RNA, 38 nt, Artificial Sequence
  Description of Artificial Sequence:  Enzymatic Nucleic Acid
  misc_feature (18)..(25): n stands for any nucleotide and can be optionally absent
ucacuaaucugaugaggnnnnnnnnccgaaaauauaua

SEQ ID NO: 4232 - RNA, 38 nt, Artificial Sequence
  Description of Artificial Sequence:  Enzymatic Nucleic Acid
  misc_feature (18)..(25): n stands for any nucleotide and can be optionally absent
aucacuaacugaugaggnnnnnnnnccgaaaaauauau

SEQ ID NO: 4233 - RNA, 38 nt, Artificial Sequence
  Description of Artificial Sequence:  Enzymatic Nucleic Acid
  misc_feature (18)..(25): n stands for any nucleotide and can be optionally absent
guaucacucugaugaggnnnnnnnnccgaaauaaauau

SEQ ID NO: 4234 - RNA, 38 nt, Artificial Sequence
  Description of Artificial Sequence:  Enzymatic Nucleic Acid
  misc_feature (18)..(25): n stands for any nucleotide and can be optionally absent
uguaucaccugaugaggnnnnnnnnccgaaaauaaaua

SEQ ID NO: 4235 - RNA, 38 nt, Artificial Sequence
  Description of Artificial Sequence:  Enzymatic Nucleic Acid
  misc_feature (18)..(25): n stands for any nucleotide and can be optionally absent
ucuaccugcugaugaggnnnnnnnnccgaaaucacuaa

SEQ ID NO: 4236 - RNA, 38 nt, Artificial Sequence
  Description of Artificial Sequence:  Enzymatic Nucleic Acid
  misc_feature (18)..(25): n stands for any nucleotide and can be optionally absent
gaaagguccugaugaggnnnnnnnnccgaaaccuguau

SEQ ID NO: 4237 - RNA, 38 nt, Artificial Sequence
  Description of Artificial Sequence:  Enzymatic Nucleic Acid
  misc_feature (18)..(25): n stands for any nucleotide and can be optionally absent
cucuacgacugaugaggnnnnnnnnccgaaaggucuac

SEQ ID NO: 4238 - RNA, 38 nt, Artificial Sequence
  Description of Artificial Sequence:  Enzymatic Nucleic Acid
  misc_feature (18)..(25): n stands for any nucleotide and can be optionally absent
ucucuacgcugaugaggnnnnnnnnccgaaaaggucua

SEQ ID NO: 4239 - RNA, 38 nt, Artificial Sequence
  Description of Artificial Sequence:  Enzymatic Nucleic Acid
  misc_feature (18)..(25): n stands for any nucleotide and can be optionally absent
aucucuaccugaugaggnnnnnnnnccgaaaaaggucu

SEQ ID NO: 4240 - RNA, 38 nt, Artificial Sequence
  Description of Artificial Sequence:  Enzymatic Nucleic Acid
  misc_feature (18)..(25): n stands for any nucleotide and can be optionally absent
uacaucuccugaugaggnnnnnnnnccgaaacgaaagg

SEQ ID NO: 4241 - RNA, 38 nt, Artificial Sequence
  Description of Artificial Sequence:  Enzymatic Nucleic Acid
  misc_feature (18)..(25): n stands for any nucleotide and can be optionally absent
uuucacugcugaugaggnnnnnnnnccgaaacaucucu

SEQ ID NO: 4242 - RNA, 38 nt, Artificial Sequence
  Description of Artificial Sequence:  Enzymatic Nucleic Acid
  misc_feature (18)..(25): n stands for any nucleotide and can be optionally absent
auuucgggcugaugaggnnnnnnnnccgaaauuucacu

SEQ ID NO: 4243 - RNA, 38 nt, Artificial Sequence
  Description of Artificial Sequence:  Enzymatic Nucleic Acid
  misc_feature (18)..(25): n stands for any nucleotide and can be optionally absent
auguguaucugaugaggnnnnnnnnccgaaauuucggg

SEQ ID NO: 4244 - RNA, 38 nt, Artificial Sequence
  Description of Artificial Sequence:  Enzymatic Nucleic Acid
  misc_feature (18)..(25): n stands for any nucleotide and can be optionally absent
cauguguacugaugaggnnnnnnnnccgaaaauuucgg

SEQ ID NO: 4245 - RNA, 38 nt, Artificial Sequence
  Description of Artificial Sequence:  Enzymatic Nucleic Acid
  misc_feature (18)..(25): n stands for any nucleotide and can be optionally absent
gucaugugcugaugaggnnnnnnnnccgaaauaauuuc

SEQ ID NO: 4246 - RNA, 38 nt, Artificial Sequence
  Description of Artificial Sequence:  Enzymatic Nucleic Acid
  misc_feature (18)..(25): n stands for any nucleotide and can be optionally absent
ggaaugaccugaugaggnnnnnnnnccgaaagcucccu

SEQ ID NO: 4247 - RNA, 38 nt, Artificial Sequence
  Description of Artificial Sequence:  Enzymatic Nucleic Acid
  misc_feature (18)..(25): n stands for any nucleotide and can be optionally absent
cagggaaucugaugaggnnnnnnnnccgaaacgagcuc

SEQ ID NO: 4248 - RNA, 38 nt, Artificial Sequence
  Description of Artificial Sequence:  Enzymatic Nucleic Acid
  misc_feature (18)..(25): n stands for any nucleotide and can be optionally absent
cggcagggcugaugaggnnnnnnnnccgaaaugacgag

SEQ ID NO: 4249 - RNA, 38 nt, Artificial Sequence
  Description of Artificial Sequence:  Enzymatic Nucleic Acid
  misc_feature (18)..(25): n stands for any nucleotide and can be optionally absent
ccggcaggcugaugaggnnnnnnnnccgaaaaugacga

SEQ ID NO: 4250 - RNA, 38 nt, Artificial Sequence
  Description of Artificial Sequence:  Enzymatic Nucleic Acid
  misc_feature (18)..(25): n stands for any nucleotide and can be optionally absent
ggugacgucugaugaggnnnnnnnnccgaaacccggca

SEQ ID NO: 4251 - RNA, 38 nt, Artificial Sequence
  Description of Artificial Sequence:  Enzymatic Nucleic Acid
  misc_feature (18)..(25): n stands for any nucleotide and can be optionally absent
aggugacgcugaugaggnnnnnnnnccgaaaacccggc

SEQ ID NO: 4252 - RNA, 38 nt, Artificial Sequence
  Description of Artificial Sequence:  Enzymatic Nucleic Acid
  misc_feature (18)..(25): n stands for any nucleotide and can be optionally absent
uguuaggucugaugaggnnnnnnnnccgaaacguaacc

SEQ ID NO: 4253 - RNA, 38 nt, Artificial Sequence
  Description of Artificial Sequence:  Enzymatic Nucleic Acid
  misc_feature (18)..(25): n stands for any nucleotide and can be optionally absent
agugaugucugaugaggnnnnnnnnccgaaaggugacg

SEQ ID NO: 4254 - RNA, 38 nt, Artificial Sequence
  Description of Artificial Sequence:  Enzymatic Nucleic Acid
  misc_feature (18)..(25): n stands for any nucleotide and can be optionally absent
guaacagucugaugaggnnnnnnnnccgaaauguuagg

SEQ ID NO: 4255 - RNA, 38 nt, Artificial Sequence
  Description of Artificial Sequence:  Enzymatic Nucleic Acid
  misc_feature (18)..(25): n stands for any nucleotide and can be optionally absent
uuuaaagucugaugaggnnnnnnnnccgaaacagugau

SEQ ID NO: 4256 - RNA, 38 nt, Artificial Sequence
  Description of Artificial Sequence:  Enzymatic Nucleic Acid
  misc_feature (18)..(25): n stands for any nucleotide and can be optionally absent
uuuuaaagcugaugaggnnnnnnnnccgaaaacaguga

SEQ ID NO: 4257 - RNA, 38 nt, Artificial Sequence
  Description of Artificial Sequence:  Enzymatic Nucleic Acid
  misc_feature (18)..(25): n stands for any nucleotide and can be optionally absent
cuuuuuuacugaugaggnnnnnnnnccgaaaguaacag

SEQ ID NO: 4258 - RNA, 38 nt, Artificial Sequence
  Description of Artificial Sequence:  Enzymatic Nucleic Acid
  misc_feature (18)..(25): n stands for any nucleotide and can be optionally absent
acuuuuuucugaugaggnnnnnnnnccgaaaaguaaca

SEQ ID NO: 4259 - RNA, 38 nt, Artificial Sequence
  Description of Artificial Sequence:  Enzymatic Nucleic Acid
  misc_feature (18)..(25): n stands for any nucleotide and can be optionally absent
aacuuuuucugaugaggnnnnnnnnccgaaaaaguaac

SEQ ID NO: 4260 - RNA, 38 nt, Artificial Sequence
  Description of Artificial Sequence:  Enzymatic Nucleic Acid
  misc_feature (18)..(25): n stands for any nucleotide and can be optionally absent
caaguggacugaugaggnnnnnnnnccgaaacuuuuuu

SEQ ID NO: 4261 - RNA, 38 nt, Artificial Sequence
  Description of Artificial Sequence:  Enzymatic Nucleic Acid
  misc_feature (18)..(25): n stands for any nucleotide and can be optionally absent
ucaaguggcugaugaggnnnnnnnnccgaaaacuuuuu

SEQ ID NO: 4262 - RNA, 38 nt, Artificial Sequence
  Description of Artificial Sequence:  Enzymatic Nucleic Acid
  misc_feature (18)..(25): n stands for any nucleotide and can be optionally absent
gucaagugcugaugaggnnnnnnnnccgaaaaacuuuu

SEQ ID NO: 4263 - RNA, 38 nt, Artificial Sequence
  Description of Artificial Sequence:  Enzymatic Nucleic Acid
  misc_feature (18)..(25): n stands for any nucleotide and can be optionally absent
aaaguguccugaugaggnnnnnnnnccgaaaguggaaa

SEQ ID NO: 4264 - RNA, 38 nt, Artificial Sequence
  Description of Artificial Sequence:  Enzymatic Nucleic Acid
  misc_feature (18)..(25): n stands for any nucleotide and can be optionally absent
agggaucacugaugaggnnnnnnnnccgaaagugucaa

SEQ ID NO: 4265 - RNA, 38 nt, Artificial Sequence
  Description of Artificial Sequence:  Enzymatic Nucleic Acid
  misc_feature (18)..(25): n stands for any nucleotide and can be optionally absent
cagggauccugaugaggnnnnnnnnccgaaaaguguca

SEQ ID NO: 4266 - RNA, 38 nt, Artificial Sequence
  Description of Artificial Sequence:  Enzymatic Nucleic Acid
  misc_feature (18)..(25): n stands for any nucleotide and can be optionally absent
ccaucaggcugaugaggnnnnnnnnccgaaaucaaagu

SEQ ID NO: 4267 - RNA, 38 nt, Artificial Sequence
  Description of Artificial Sequence:  Enzymatic Nucleic Acid
  misc_feature (18)..(25): n stands for any nucleotide and can be optionally absent
ucccagaucugaugaggnnnnnnnnccgaaaugcguuu

SEQ ID NO: 4268 - RNA, 38 nt, Artificial Sequence
  Description of Artificial Sequence:  Enzymatic Nucleic Acid
  misc_feature (18)..(25): n stands for any nucleotide and can be optionally absent
cugucccacugaugaggnnnnnnnnccgaaauuaugcg

SEQ ID NO: 4269 - RNA, 38 nt, Artificial Sequence
  Description of Artificial Sequence:  Enzymatic Nucleic Acid
  misc_feature (18)..(25): n stands for any nucleotide and can be optionally absent
gcccuuuccugaugaggnnnnnnnnccgaaacuguccc

SEQ ID NO: 4270 - RNA, 38 nt, Artificial Sequence
  Description of Artificial Sequence:  Enzymatic Nucleic Acid
  misc_feature (18)..(25): n stands for any nucleotide and can be optionally absent
auaugaugcugaugaggnnnnnnnnccgaaagcccuuu

SEQ ID NO: 4271 - RNA, 38 nt, Artificial Sequence
  Description of Artificial Sequence:  Enzymatic Nucleic Acid
  misc_feature (18)..(25): n stands for any nucleotide and can be optionally absent
gauaugaucugaugaggnnnnnnnnccgaaaagcccuu

SEQ ID NO: 4272 - RNA, 38 nt, Artificial Sequence
  Description of Artificial Sequence:  Enzymatic Nucleic Acid
  misc_feature (18)..(25): n stands for any nucleotide and can be optionally absent
uuugauaucugaugaggnnnnnnnnccgaaaugaagcc

SEQ ID NO: 4273 - RNA, 38 nt, Artificial Sequence
  Description of Artificial Sequence:  Enzymatic Nucleic Acid
  misc_feature (18)..(25): n stands for any nucleotide and can be optionally absent
gcauuugacugaugaggnnnnnnnnccgaaaugaugaa

SEQ ID NO: 4274 - RNA, 38 nt, Artificial Sequence
  Description of Artificial Sequence:  Enzymatic Nucleic Acid
  misc_feature (18)..(25): n stands for any nucleotide and can be optionally absent
uugcauuucugaugaggnnnnnnnnccgaaauaugaug

SEQ ID NO: 4275 - RNA, 38 nt, Artificial Sequence
  Description of Artificial Sequence:  Enzymatic Nucleic Acid
  misc_feature (18)..(25): n stands for any nucleotide and can be optionally absent
uuucuuugcugaugaggnnnnnnnnccgaaacguugca

SEQ ID NO: 4276 - RNA, 38 nt, Artificial Sequence
  Description of Artificial Sequence:  Enzymatic Nucleic Acid
  misc_feature (18)..(25): n stands for any nucleotide and can be optionally absent
agaagccccugaugaggnnnnnnnnccgaaauuucuuu

SEQ ID NO: 4277 - RNA, 38 nt, Artificial Sequence
  Description of Artificial Sequence:  Enzymatic Nucleic Acid
  misc_feature (18)..(25): n stands for any nucleotide and can be optionally absent
caggucagcugaugaggnnnnnnnnccgaaagcccuau

SEQ ID NO: 4278 - RNA, 38 nt, Artificial Sequence
  Description of Artificial Sequence:  Enzymatic Nucleic Acid
  misc_feature (18)..(25): n stands for any nucleotide and can be optionally absent
acaggucacugaugaggnnnnnnnnccgaaaagcccua

SEQ ID NO: 4279 - RNA, 38 nt, Artificial Sequence
  Description of Artificial Sequence:  Enzymatic Nucleic Acid
  misc_feature (18)..(25): n stands for any nucleotide and can be optionally absent
ugcccauucugaugaggnnnnnnnnccgaaacuguugc

SEQ ID NO: 4280 - RNA, 38 nt, Artificial Sequence
  Description of Artificial Sequence:  Enzymatic Nucleic Acid
  misc_feature (18)..(25): n stands for any nucleotide and can be optionally absent
cuuauacacugaugaggnnnnnnnnccgaaaugcccau

SEQ ID NO: 4281 - RNA, 38 nt, Artificial Sequence
  Description of Artificial Sequence:  Enzymatic Nucleic Acid
  misc_feature (18)..(25): n stands for any nucleotide and can be optionally absent
ucuuauaccugaugaggnnnnnnnnccgaaaaugccca

SEQ ID NO: 4282 - RNA, 38 nt, Artificial Sequence
  Description of Artificial Sequence:  Enzymatic Nucleic Acid
  misc_feature (18)..(25): n stands for any nucleotide and can be optionally absent
uugucuuacugaugaggnnnnnnnnccgaaacaaaugc

SEQ ID NO: 4283 - RNA, 38 nt, Artificial Sequence
  Description of Artificial Sequence:  Enzymatic Nucleic Acid
  misc_feature (18)..(25): n stands for any nucleotide and can be optionally absent
guuugucucugaugaggnnnnnnnnccgaaauacaaau

SEQ ID NO: 4284 - RNA, 38 nt, Artificial Sequence
  Description of Artificial Sequence:  Enzymatic Nucleic Acid
  misc_feature (18)..(25): n stands for any nucleotide and can be optionally absent
gugugagacugaugaggnnnnnnnnccgaaaguuuguc

SEQ ID NO: 4285 - RNA, 38 nt, Artificial Sequence
  Description of Artificial Sequence:  Enzymatic Nucleic Acid
  misc_feature (18)..(25): n stands for any nucleotide and can be optionally absent
augugugacugaugaggnnnnnnnnccgaaauaguuug

SEQ ID NO: 4286 - RNA, 38 nt, Artificial Sequence
  Description of Artificial Sequence:  Enzymatic Nucleic Acid
  misc_feature (18)..(25): n stands for any nucleotide and can be optionally absent
cgaugugucugaugaggnnnnnnnnccgaaagauaguu

SEQ ID NO: 4287 - RNA, 38 nt, Artificial Sequence
  Description of Artificial Sequence:  Enzymatic Nucleic Acid
  misc_feature (18)..(25): n stands for any nucleotide and can be optionally absent
gguuuguccugaugaggnnnnnnnnccgaaauguguga

SEQ ID NO: 4288 - RNA, 38 nt, Artificial Sequence
  Description of Artificial Sequence:  Enzymatic Nucleic Acid
  misc_feature (18)..(25): n stands for any nucleotide and can be optionally absent
uaugauugcugaugaggnnnnnnnnccgaaauugguuu

SEQ ID NO: 4289 - RNA, 38 nt, Artificial Sequence
  Description of Artificial Sequence:  Enzymatic Nucleic Acid
  misc_feature (18)..(25): n stands for any nucleotide and can be optionally absent
acaucuaucugaugaggnnnnnnnnccgaaauuguauu

SEQ ID NO: 4290 - RNA, 38 nt, Artificial Sequence
  Description of Artificial Sequence:  Enzymatic Nucleic Acid
  misc_feature (18)..(25): n stands for any nucleotide and can be optionally absent
uggacauccugaugaggnnnnnnnnccgaaaugauugu

SEQ ID NO: 4291 - RNA, 38 nt, Artificial Sequence
  Description of Artificial Sequence:  Enzymatic Nucleic Acid
  misc_feature (18)..(25): n stands for any nucleotide and can be optionally absent
cuuauuugcugaugaggnnnnnnnnccgaaacaucuau

SEQ ID NO: 4292 - RNA, 38 nt, Artificial Sequence
  Description of Artificial Sequence:  Enzymatic Nucleic Acid
  misc_feature (18)..(25): n stands for any nucleotide and can be optionally absent
ggugugcucugaugaggnnnnnnnnccgaaauuuggac

SEQ ID NO: 4293 - RNA, 38 nt, Artificial Sequence
  Description of Artificial Sequence:  Enzymatic Nucleic Acid
  misc_feature (18)..(25): n stands for any nucleotide and can be optionally absent
aguaauuucugaugaggnnnnnnnnccgaaacugggcg

SEQ ID NO: 4294 - RNA, 38 nt, Artificial Sequence
  Description of Artificial Sequence:  Enzymatic Nucleic Acid
  misc_feature (18)..(25): n stands for any nucleotide and can be optionally absent
cucuaagucugaugaggnnnnnnnnccgaaauuugacu

SEQ ID NO: 4295 - RNA, 38 nt, Artificial Sequence
  Description of Artificial Sequence:  Enzymatic Nucleic Acid
  misc_feature (18)..(25): n stands for any nucleotide and can be optionally absent
ccucuaagcugaugaggnnnnnnnnccgaaaauuugac

SEQ ID NO: 4296 - RNA, 38 nt, Artificial Sequence
  Description of Artificial Sequence:  Enzymatic Nucleic Acid
  misc_feature (18)..(25): n stands for any nucleotide and can be optionally absent
uggccucucugaugaggnnnnnnnnccgaaaguaauuu

SEQ ID NO: 4297 - RNA, 38 nt, Artificial Sequence
  Description of Artificial Sequence:  Enzymatic Nucleic Acid
  misc_feature (18)..(25): n stands for any nucleotide and can be optionally absent
auggccuccugaugaggnnnnnnnnccgaaaaguaauu

SEQ ID NO: 4298 - RNA, 38 nt, Artificial Sequence
  Description of Artificial Sequence:  Enzymatic Nucleic Acid
  misc_feature (18)..(25): n stands for any nucleotide and can be optionally absent
gacaagagcugaugaggnnnnnnnnccgaaauggccuc

SEQ ID NO: 4299 - RNA, 38 nt, Artificial Sequence
  Description of Artificial Sequence:  Enzymatic Nucleic Acid
  misc_feature (18)..(25): n stands for any nucleotide and can be optionally absent
gaggacaacugaugaggnnnnnnnnccgaaaguauggc

SEQ ID NO: 4300 - RNA, 38 nt, Artificial Sequence
  Description of Artificial Sequence:  Enzymatic Nucleic Acid
  misc_feature (18)..(25): n stands for any nucleotide and can be optionally absent
uugaggaccugaugaggnnnnnnnnccgaaagaguaug

SEQ ID NO: 4301 - RNA, 38 nt, Artificial Sequence
  Description of Artificial Sequence:  Enzymatic Nucleic Acid
  misc_feature (18)..(25): n stands for any nucleotide and can be optionally absent
caauugagcugaugaggnnnnnnnnccgaaacaagagu

SEQ ID NO: 4302 - RNA, 38 nt, Artificial Sequence
  Description of Artificial Sequence:  Enzymatic Nucleic Acid
  misc_feature (18)..(25): n stands for any nucleotide and can be optionally absent
guacaauucugaugaggnnnnnnnnccgaaaggacaag

SEQ ID NO: 4303 - RNA, 38 nt, Artificial Sequence
  Description of Artificial Sequence:  Enzymatic Nucleic Acid
  misc_feature (18)..(25): n stands for any nucleotide and can be optionally absent
agcaguaccugaugaggnnnnnnnnccgaaauugagga

SEQ ID NO: 4304 - RNA, 38 nt, Artificial Sequence
  Description of Artificial Sequence:  Enzymatic Nucleic Acid
  misc_feature (18)..(25): n stands for any nucleotide and can be optionally absent
gguagcagcugaugaggnnnnnnnnccgaaacaauuga

SEQ ID NO: 4305 - RNA, 38 nt, Artificial Sequence
  Description of Artificial Sequence:  Enzymatic Nucleic Acid
  misc_feature (18)..(25): n stands for any nucleotide and can be optionally absent
gggaguggcugaugaggnnnnnnnnccgaaagcaguac

SEQ ID NO: 4306 - RNA, 38 nt, Artificial Sequence
  Description of Artificial Sequence:  Enzymatic Nucleic Acid
  misc_feature (18)..(25): n stands for any nucleotide and can be optionally absent
guucaaggcugaugaggnnnnnnnnccgaaagugguag

SEQ ID NO: 4307 - RNA, 38 nt, Artificial Sequence
  Description of Artificial Sequence:  Enzymatic Nucleic Acid
  misc_feature (18)..(25): n stands for any nucleotide and can be optionally absent
ucguguuccugaugaggnnnnnnnnccgaaagggagug

SEQ ID NO: 4308 - RNA, 38 nt, Artificial Sequence
  Description of Artificial Sequence:  Enzymatic Nucleic Acid
  misc_feature (18)..(25): n stands for any nucleotide and can be optionally absent
gucauuugcugaugaggnnnnnnnnccgaaacucucgu

SEQ ID NO: 4309 - RNA, 38 nt, Artificial Sequence
  Description of Artificial Sequence:  Enzymatic Nucleic Acid
  misc_feature (18)..(25): n stands for any nucleotide and can be optionally absent
ggucauuucugaugaggnnnnnnnnccgaaaacucucg

SEQ ID NO: 4310 - RNA, 38 nt, Artificial Sequence
  Description of Artificial Sequence:  Enzymatic Nucleic Acid
  misc_feature (18)..(25): n stands for any nucleotide and can be optionally absent
aucagggucugaugaggnnnnnnnnccgaaacuccagg

SEQ ID NO: 4311 - RNA, 38 nt, Artificial Sequence
  Description of Artificial Sequence:  Enzymatic Nucleic Acid
  misc_feature (18)..(25): n stands for any nucleotide and can be optionally absent
caucagggcugaugaggnnnnnnnnccgaaaacuccag

SEQ ID NO: 4312 - RNA, 38 nt, Artificial Sequence
  Description of Artificial Sequence:  Enzymatic Nucleic Acid
  misc_feature (18)..(25): n stands for any nucleotide and can be optionally absent
agcucucucugaugaggnnnnnnnnccgaaauuuuuuu

SEQ ID NO: 4313 - RNA, 38 nt, Artificial Sequence
  Description of Artificial Sequence:  Enzymatic Nucleic Acid
  misc_feature (18)..(25): n stands for any nucleotide and can be optionally absent
ccuuacggcugaugaggnnnnnnnnccgaaagcucucu

SEQ ID NO: 4314 - RNA, 38 nt, Artificial Sequence
  Description of Artificial Sequence:  Enzymatic Nucleic Acid
  misc_feature (18)..(25): n stands for any nucleotide and can be optionally absent
gccuuacgcugaugaggnnnnnnnnccgaaaagcucuc

SEQ ID NO: 4315 - RNA, 38 nt, Artificial Sequence
  Description of Artificial Sequence:  Enzymatic Nucleic Acid
  misc_feature (18)..(25): n stands for any nucleotide and can be optionally absent
cgucgccucugaugaggnnnnnnnnccgaaacggaagc

SEQ ID NO: 4316 - RNA, 38 nt, Artificial Sequence
  Description of Artificial Sequence:  Enzymatic Nucleic Acid
  misc_feature (18)..(25): n stands for any nucleotide and can be optionally absent
cuuugguccugaugaggnnnnnnnnccgaaauucgucg

SEQ ID NO: 4317 - RNA, 38 nt, Artificial Sequence
  Description of Artificial Sequence:  Enzymatic Nucleic Acid
  misc_feature (18)..(25): n stands for any nucleotide and can be optionally absent
ggcaugggcugaugaggnnnnnnnnccgaaauugcuuu

SEQ ID NO: 4318 - RNA, 38 nt, Artificial Sequence
  Description of Artificial Sequence:  Enzymatic Nucleic Acid
  misc_feature (18)..(25): n stands for any nucleotide and can be optionally absent
uggcauggcugaugaggnnnnnnnnccgaaaauugcuu

SEQ ID NO: 4319 - RNA, 38 nt, Artificial Sequence
  Description of Artificial Sequence:  Enzymatic Nucleic Acid
  misc_feature (18)..(25): n stands for any nucleotide and can be optionally absent
cuguagaacugaugaggnnnnnnnnccgaaauguuggc

SEQ ID NO: 4320 - RNA, 38 nt, Artificial Sequence
  Description of Artificial Sequence:  Enzymatic Nucleic Acid
  misc_feature (18)..(25): n stands for any nucleotide and can be optionally absent
cacuguagcugaugaggnnnnnnnnccgaaauauguug

SEQ ID NO: 4321 - RNA, 38 nt, Artificial Sequence
  Description of Artificial Sequence:  Enzymatic Nucleic Acid
  misc_feature (18)..(25): n stands for any nucleotide and can be optionally absent
acacuguacugaugaggnnnnnnnnccgaaaauauguu

SEQ ID NO: 4322 - RNA, 38 nt, Artificial Sequence
  Description of Artificial Sequence:  Enzymatic Nucleic Acid
  misc_feature (18)..(25): n stands for any nucleotide and can be optionally absent
gaacacugcugaugaggnnnnnnnnccgaaagaauaug

SEQ ID NO: 4323 - RNA, 38 nt, Artificial Sequence
  Description of Artificial Sequence:  Enzymatic Nucleic Acid
  misc_feature (18)..(25): n stands for any nucleotide and can be optionally absent
auaguaagcugaugaggnnnnnnnnccgaaacacugua

SEQ ID NO: 4324 - RNA, 38 nt, Artificial Sequence
  Description of Artificial Sequence:  Enzymatic Nucleic Acid
  misc_feature (18)..(25): n stands for any nucleotide and can be optionally absent
aauaguaacugaugaggnnnnnnnnccgaaaacacugu

SEQ ID NO: 4325 - RNA, 38 nt, Artificial Sequence
  Description of Artificial Sequence:  Enzymatic Nucleic Acid
  misc_feature (18)..(25): n stands for any nucleotide and can be optionally absent
ucaauagucugaugaggnnnnnnnnccgaaagaacacu

SEQ ID NO: 4326 - RNA, 38 nt, Artificial Sequence
  Description of Artificial Sequence:  Enzymatic Nucleic Acid
  misc_feature (18)..(25): n stands for any nucleotide and can be optionally absent
gucaauagcugaugaggnnnnnnnnccgaaaagaacac

SEQ ID NO: 4327 - RNA, 38 nt, Artificial Sequence
  Description of Artificial Sequence:  Enzymatic Nucleic Acid
  misc_feature (18)..(25): n stands for any nucleotide and can be optionally absent
uuugucaacugaugaggnnnnnnnnccgaaaguaagaa

SEQ ID NO: 4328 - RNA, 38 nt, Artificial Sequence
  Description of Artificial Sequence:  Enzymatic Nucleic Acid
  misc_feature (18)..(25): n stands for any nucleotide and can be optionally absent
auuuuguccugaugaggnnnnnnnnccgaaauaguaag

SEQ ID NO: 4329 - RNA, 38 nt, Artificial Sequence
  Description of Artificial Sequence:  Enzymatic Nucleic Acid
  misc_feature (18)..(25): n stands for any nucleotide and can be optionally absent
caaguauacugaugaggnnnnnnnnccgaaaguccuuu

SEQ ID NO: 4330 - RNA, 38 nt, Artificial Sequence
  Description of Artificial Sequence:  Enzymatic Nucleic Acid
  misc_feature (18)..(25): n stands for any nucleotide and can be optionally absent
acaaguaucugaugaggnnnnnnnnccgaaaaguccuu

SEQ ID NO: 4331 - RNA, 38 nt, Artificial Sequence
  Description of Artificial Sequence:  Enzymatic Nucleic Acid
  misc_feature (18)..(25): n stands for any nucleotide and can be optionally absent
gacaaguacugaugaggnnnnnnnnccgaaaaaguccu

SEQ ID NO: 4332 - RNA, 38 nt, Artificial Sequence
  Description of Artificial Sequence:  Enzymatic Nucleic Acid
  misc_feature (18)..(25): n stands for any nucleotide and can be optionally absent
acgacaagcugaugaggnnnnnnnnccgaaauaaaguc

SEQ ID NO: 4333 - RNA, 38 nt, Artificial Sequence
  Description of Artificial Sequence:  Enzymatic Nucleic Acid
  misc_feature (18)..(25): n stands for any nucleotide and can be optionally absent
uacacgaccugaugaggnnnnnnnnccgaaaguauaaa

SEQ ID NO: 4334 - RNA, 38 nt, Artificial Sequence
  Description of Artificial Sequence:  Enzymatic Nucleic Acid
  misc_feature (18)..(25): n stands for any nucleotide and can be optionally absent
ccuuacaccugaugaggnnnnnnnnccgaaacaaguau

SEQ ID NO: 4335 - RNA, 38 nt, Artificial Sequence
  Description of Artificial Sequence:  Enzymatic Nucleic Acid
  misc_feature (18)..(25): n stands for any nucleotide and can be optionally absent
ccacuccucugaugaggnnnnnnnnccgaaacacgaca

SEQ ID NO: 4336 - RNA, 38 nt, Artificial Sequence
  Description of Artificial Sequence:  Enzymatic Nucleic Acid
  misc_feature (18)..(25): n stands for any nucleotide and can be optionally absent
auuugaaucugaugaggnnnnnnnnccgaaauggucca

SEQ ID NO: 4337 - RNA, 38 nt, Artificial Sequence
  Description of Artificial Sequence:  Enzymatic Nucleic Acid
  misc_feature (18)..(25): n stands for any nucleotide and can be optionally absent
cagauuugcugaugaggnnnnnnnnccgaaaugauggu

SEQ ID NO: 4338 - RNA, 38 nt, Artificial Sequence
  Description of Artificial Sequence:  Enzymatic Nucleic Acid
  misc_feature (18)..(25): n stands for any nucleotide and can be optionally absent
acagauuucugaugaggnnnnnnnnccgaaaaugaugg

SEQ ID NO: 4339 - RNA, 38 nt, Artificial Sequence
  Description of Artificial Sequence:  Enzymatic Nucleic Acid
  misc_feature (18)..(25): n stands for any nucleotide and can be optionally absent
uguuaacacugaugaggnnnnnnnnccgaaauuugaau

SEQ ID NO: 4340 - RNA, 38 nt, Artificial Sequence
  Description of Artificial Sequence:  Enzymatic Nucleic Acid
  misc_feature (18)..(25): n stands for any nucleotide and can be optionally absent
gagguguucugaugaggnnnnnnnnccgaaacagauuu

SEQ ID NO: 4341 - RNA, 38 nt, Artificial Sequence
  Description of Artificial Sequence:  Enzymatic Nucleic Acid
  misc_feature (18)..(25): n stands for any nucleotide and can be optionally absent
ugaggugucugaugaggnnnnnnnnccgaaaacagauu

SEQ ID NO: 4342 - RNA, 38 nt, Artificial Sequence
  Description of Artificial Sequence:  Enzymatic Nucleic Acid
  misc_feature (18)..(25): n stands for any nucleotide and can be optionally absent
uaugcacucugaugaggnnnnnnnnccgaaagguguua

SEQ ID NO: 4343 - RNA, 38 nt, Artificial Sequence
  Description of Artificial Sequence:  Enzymatic Nucleic Acid
  misc_feature (18)..(25): n stands for any nucleotide and can be optionally absent
aucauauacugaugaggnnnnnnnnccgaaaugcacug

SEQ ID NO: 4344 - RNA, 38 nt, Artificial Sequence
  Description of Artificial Sequence:  Enzymatic Nucleic Acid
  misc_feature (18)..(25): n stands for any nucleotide and can be optionally absent
uuaucauacugaugaggnnnnnnnnccgaaauaugcac

SEQ ID NO: 4345 - RNA, 38 nt, Artificial Sequence
  Description of Artificial Sequence:  Enzymatic Nucleic Acid
  misc_feature (18)..(25): n stands for any nucleotide and can be optionally absent
cuuuaucacugaugaggnnnnnnnnccgaaauauaugc

SEQ ID NO: 4346 - RNA, 38 nt, Artificial Sequence
  Description of Artificial Sequence:  Enzymatic Nucleic Acid
  misc_feature (18)..(25): n stands for any nucleotide and can be optionally absent
gaaugcuucugaugaggnnnnnnnnccgaaaucauaua

SEQ ID NO: 4347 - RNA, 38 nt, Artificial Sequence
  Description of Artificial Sequence:  Enzymatic Nucleic Acid
  misc_feature (18)..(25): n stands for any nucleotide and can be optionally absent
cagugaugcugaugaggnnnnnnnnccgaaaugcuuua

SEQ ID NO: 4348 - RNA, 38 nt, Artificial Sequence
  Description of Artificial Sequence:  Enzymatic Nucleic Acid
  misc_feature (18)..(25): n stands for any nucleotide and can be optionally absent
acagugaucugaugaggnnnnnnnnccgaaaaugcuuu

SEQ ID NO: 4349 - RNA, 38 nt, Artificial Sequence
  Description of Artificial Sequence:  Enzymatic Nucleic Acid
  misc_feature (18)..(25): n stands for any nucleotide and can be optionally absent
uucacagucugaugaggnnnnnnnnccgaaaugaaugc

SEQ ID NO: 4350 - RNA, 38 nt, Artificial Sequence
  Description of Artificial Sequence:  Enzymatic Nucleic Acid
  misc_feature (18)..(25): n stands for any nucleotide and can be optionally absent
cuguuuuccugaugaggnnnnnnnnccgaaauguuuca

SEQ ID NO: 4351 - RNA, 38 nt, Artificial Sequence
  Description of Artificial Sequence:  Enzymatic Nucleic Acid
  misc_feature (18)..(25): n stands for any nucleotide and can be optionally absent
acgguuuccugaugaggnnnnnnnnccgaaagcaccug

SEQ ID NO: 4352 - RNA, 38 nt, Artificial Sequence
  Description of Artificial Sequence:  Enzymatic Nucleic Acid
  misc_feature (18)..(25): n stands for any nucleotide and can be optionally absent
uugccagccugaugaggnnnnnnnnccgaaacgguuuc

SEQ ID NO: 4353 - RNA, 38 nt, Artificial Sequence
  Description of Artificial Sequence:  Enzymatic Nucleic Acid
  misc_feature (18)..(25): n stands for any nucleotide and can be optionally absent
gccgguaacugaugaggnnnnnnnnccgaaaccgcuug

SEQ ID NO: 4354 - RNA, 38 nt, Artificial Sequence
  Description of Artificial Sequence:  Enzymatic Nucleic Acid
  misc_feature (18)..(25): n stands for any nucleotide and can be optionally absent
gagccggucugaugaggnnnnnnnnccgaaagaccgcu

SEQ ID NO: 4355 - RNA, 38 nt, Artificial Sequence
  Description of Artificial Sequence:  Enzymatic Nucleic Acid
  misc_feature (18)..(25): n stands for any nucleotide and can be optionally absent
agagccggcugaugaggnnnnnnnnccgaaaagaccgc

SEQ ID NO: 4356 - RNA, 38 nt, Artificial Sequence
  Description of Artificial Sequence:  Enzymatic Nucleic Acid
  misc_feature (18)..(25): n stands for any nucleotide and can be optionally absent
uucauagacugaugaggnnnnnnnnccgaaagccggua

SEQ ID NO: 4357 - RNA, 38 nt, Artificial Sequence
  Description of Artificial Sequence:  Enzymatic Nucleic Acid
  misc_feature (18)..(25): n stands for any nucleotide and can be optionally absent
cuuucauacugaugaggnnnnnnnnccgaaagagccgg

SEQ ID NO: 4358 - RNA, 38 nt, Artificial Sequence
  Description of Artificial Sequence:  Enzymatic Nucleic Acid
  misc_feature (18)..(25): n stands for any nucleotide and can be optionally absent
cacuuucacugaugaggnnnnnnnnccgaaagagagcc

SEQ ID NO: 4359 - RNA, 38 nt, Artificial Sequence
  Description of Artificial Sequence:  Enzymatic Nucleic Acid
  misc_feature (18)..(25): n stands for any nucleotide and can be optionally absent
gcgagggacugaugaggnnnnnnnnccgaaaugccuuc

SEQ ID NO: 4360 - RNA, 38 nt, Artificial Sequence
  Description of Artificial Sequence:  Enzymatic Nucleic Acid
  misc_feature (18)..(25): n stands for any nucleotide and can be optionally absent
ggcgagggcugaugaggnnnnnnnnccgaaaaugccuu

SEQ ID NO: 4361 - RNA, 38 nt, Artificial Sequence
  Description of Artificial Sequence:  Enzymatic Nucleic Acid
  misc_feature (18)..(25): n stands for any nucleotide and can be optionally absent
cggcgaggcugaugaggnnnnnnnnccgaaaaaugccu

SEQ ID NO: 4362 - RNA, 38 nt, Artificial Sequence
  Description of Artificial Sequence:  Enzymatic Nucleic Acid
  misc_feature (18)..(25): n stands for any nucleotide and can be optionally absent
cuuccggccugaugaggnnnnnnnnccgaaagggaaau

SEQ ID NO: 4363 - RNA, 38 nt, Artificial Sequence
  Description of Artificial Sequence:  Enzymatic Nucleic Acid
  misc_feature (18)..(25): n stands for any nucleotide and can be optionally absent
aaccauaccugaugaggnnnnnnnnccgaaacuuccgg

SEQ ID NO: 4364 - RNA, 38 nt, Artificial Sequence
  Description of Artificial Sequence:  Enzymatic Nucleic Acid
  misc_feature (18)..(25): n stands for any nucleotide and can be optionally absent
uuuaaccacugaugaggnnnnnnnnccgaaacaacuuc

SEQ ID NO: 4365 - RNA, 38 nt, Artificial Sequence
  Description of Artificial Sequence:  Enzymatic Nucleic Acid
  misc_feature (18)..(25): n stands for any nucleotide and can be optionally absent
caucuuuucugaugaggnnnnnnnnccgaaaccauaca

SEQ ID NO: 4366 - RNA, 38 nt, Artificial Sequence
  Description of Artificial Sequence:  Enzymatic Nucleic Acid
  misc_feature (18)..(25): n stands for any nucleotide and can be optionally absent
ccaucuuucugaugaggnnnnnnnnccgaaaaccauac

SEQ ID NO: 4367 - RNA, 38 nt, Artificial Sequence
  Description of Artificial Sequence:  Enzymatic Nucleic Acid
  misc_feature (18)..(25): n stands for any nucleotide and can be optionally absent
ucgcaggucugaugaggnnnnnnnnccgaaacccaucu

SEQ ID NO: 4368 - RNA, 38 nt, Artificial Sequence
  Description of Artificial Sequence:  Enzymatic Nucleic Acid
  misc_feature (18)..(25): n stands for any nucleotide and can be optionally absent
gucgcaggcugaugaggnnnnnnnnccgaaaacccauc

SEQ ID NO: 4369 - RNA, 38 nt, Artificial Sequence
  Description of Artificial Sequence:  Enzymatic Nucleic Acid
  misc_feature (18)..(25): n stands for any nucleotide and can be optionally absent
agcgagcacugaugaggnnnnnnnnccgaaauuucuca

SEQ ID NO: 4370 - RNA, 38 nt, Artificial Sequence
  Description of Artificial Sequence:  Enzymatic Nucleic Acid
  misc_feature (18)..(25): n stands for any nucleotide and can be optionally absent
caaauagccugaugaggnnnnnnnnccgaaagcagauu

SEQ ID NO: 4371 - RNA, 38 nt, Artificial Sequence
  Description of Artificial Sequence:  Enzymatic Nucleic Acid
  misc_feature (18)..(25): n stands for any nucleotide and can be optionally absent
gagucaaacugaugaggnnnnnnnnccgaaagcgagca

SEQ ID NO: 4372 - RNA, 38 nt, Artificial Sequence
  Description of Artificial Sequence:  Enzymatic Nucleic Acid
  misc_feature (18)..(25): n stands for any nucleotide and can be optionally absent
acgagucacugaugaggnnnnnnnnccgaaauagcgag

SEQ ID NO: 4373 - RNA, 38 nt, Artificial Sequence
  Description of Artificial Sequence:  Enzymatic Nucleic Acid
  misc_feature (18)..(25): n stands for any nucleotide and can be optionally absent
cacgaguccugaugaggnnnnnnnnccgaaaauagcga

SEQ ID NO: 4374 - RNA, 38 nt, Artificial Sequence
  Description of Artificial Sequence:  Enzymatic Nucleic Acid
  misc_feature (18)..(25): n stands for any nucleotide and can be optionally absent
guagccaccugaugaggnnnnnnnnccgaaagucaaau

SEQ ID NO: 4375 - RNA, 38 nt, Artificial Sequence
  Description of Artificial Sequence:  Enzymatic Nucleic Acid
  misc_feature (18)..(25): n stands for any nucleotide and can be optionally absent
uuaacgagcugaugaggnnnnnnnnccgaaagccacga

SEQ ID NO: 4376 - RNA, 38 nt, Artificial Sequence
  Description of Artificial Sequence:  Enzymatic Nucleic Acid
  misc_feature (18)..(25): n stands for any nucleotide and can be optionally absent
uaauuaaccugaugaggnnnnnnnnccgaaaguagcca

SEQ ID NO: 4377 - RNA, 38 nt, Artificial Sequence
  Description of Artificial Sequence:  Enzymatic Nucleic Acid
  misc_feature (18)..(25): n stands for any nucleotide and can be optionally absent
ugauaauucugaugaggnnnnnnnnccgaaacgaguag

SEQ ID NO: 4378 - RNA, 38 nt, Artificial Sequence
  Description of Artificial Sequence:  Enzymatic Nucleic Acid
  misc_feature (18)..(25): n stands for any nucleotide and can be optionally absent
uugauaaucugaugaggnnnnnnnnccgaaaacgagua

SEQ ID NO: 4379 - RNA, 38 nt, Artificial Sequence
  Description of Artificial Sequence:  Enzymatic Nucleic Acid
  misc_feature (18)..(25): n stands for any nucleotide and can be optionally absent
uccuugaucugaugaggnnnnnnnnccgaaauuaacga

SEQ ID NO: 4380 - RNA, 38 nt, Artificial Sequence
  Description of Artificial Sequence:  Enzymatic Nucleic Acid
  misc_feature (18)..(25): n stands for any nucleotide and can be optionally absent
guccuugacugaugaggnnnnnnnnccgaaaauuaacg

SEQ ID NO: 4381 - RNA, 38 nt, Artificial Sequence
  Description of Artificial Sequence:  Enzymatic Nucleic Acid
  misc_feature (18)..(25): n stands for any nucleotide and can be optionally absent
acguccuucugaugaggnnnnnnnnccgaaauaauuaa

SEQ ID NO: 4382 - RNA, 38 nt, Artificial Sequence
  Description of Artificial Sequence:  Enzymatic Nucleic Acid
  misc_feature (18)..(25): n stands for any nucleotide and can be optionally absent
ucuucagucugaugaggnnnnnnnnccgaaacguccuu

SEQ ID NO: 4383 - RNA, 38 nt, Artificial Sequence
  Description of Artificial Sequence:  Enzymatic Nucleic Acid
  misc_feature (18)..(25): n stands for any nucleotide and can be optionally absent
gauuguaucugaugaggnnnnnnnnccgaaauucccug

SEQ ID NO: 4384 - RNA, 38 nt, Artificial Sequence
  Description of Artificial Sequence:  Enzymatic Nucleic Acid
  misc_feature (18)..(25): n stands for any nucleotide and can be optionally absent
agauuguacugaugaggnnnnnnnnccgaaaauucccu

SEQ ID NO: 4385 - RNA, 38 nt, Artificial Sequence
  Description of Artificial Sequence:  Enzymatic Nucleic Acid
  misc_feature (18)..(25): n stands for any nucleotide and can be optionally absent
caagauugcugaugaggnnnnnnnnccgaaauaauucc

SEQ ID NO: 4386 - RNA, 38 nt, Artificial Sequence
  Description of Artificial Sequence:  Enzymatic Nucleic Acid
  misc_feature (18)..(25): n stands for any nucleotide and can be optionally absent
cucagcaacugaugaggnnnnnnnnccgaaauuguaua

SEQ ID NO: 4387 - RNA, 38 nt, Artificial Sequence
  Description of Artificial Sequence:  Enzymatic Nucleic Acid
  misc_feature (18)..(25): n stands for any nucleotide and can be optionally absent
ugcucagccugaugaggnnnnnnnnccgaaagauugua

SEQ ID NO: 4388 - RNA, 38 nt, Artificial Sequence
  Description of Artificial Sequence:  Enzymatic Nucleic Acid
  misc_feature (18)..(25): n stands for any nucleotide and can be optionally absent
gacuguuucugaugaggnnnnnnnnccgaaaugcucag

SEQ ID NO: 4389 - RNA, 38 nt, Artificial Sequence
  Description of Artificial Sequence:  Enzymatic Nucleic Acid
  misc_feature (18)..(25): n stands for any nucleotide and can be optionally absent
acacauuucugaugaggnnnnnnnnccgaaacuguuuu

SEQ ID NO: 4390 - RNA, 38 nt, Artificial Sequence
  Description of Artificial Sequence:  Enzymatic Nucleic Acid
  misc_feature (18)..(25): n stands for any nucleotide and can be optionally absent
gguuuuuacugaugaggnnnnnnnnccgaaacacauuu

SEQ ID NO: 4391 - RNA, 38 nt, Artificial Sequence
  Description of Artificial Sequence:  Enzymatic Nucleic Acid
  misc_feature (18)..(25): n stands for any nucleotide and can be optionally absent
agguuuuucugaugaggnnnnnnnnccgaaaacacauu

SEQ ID NO: 4392 - RNA, 38 nt, Artificial Sequence
  Description of Artificial Sequence:  Enzymatic Nucleic Acid
  misc_feature (18)..(25): n stands for any nucleotide and can be optionally absent
gagguuuucugaugaggnnnnnnnnccgaaaaacacau

SEQ ID NO: 4393 - RNA, 38 nt, Artificial Sequence
  Description of Artificial Sequence:  Enzymatic Nucleic Acid
  misc_feature (18)..(25): n stands for any nucleotide and can be optionally absent
guggcagucugaugaggnnnnnnnnccgaaagguuuuu

SEQ ID NO: 4394 - RNA, 38 nt, Artificial Sequence
  Description of Artificial Sequence:  Enzymatic Nucleic Acid
  misc_feature (18)..(25): n stands for any nucleotide and can be optionally absent
gacaauuacugaugaggnnnnnnnnccgaaaguggcag

SEQ ID NO: 4395 - RNA, 38 nt, Artificial Sequence
  Description of Artificial Sequence:  Enzymatic Nucleic Acid
  misc_feature (18)..(25): n stands for any nucleotide and can be optionally absent
uugacaaucugaugaggnnnnnnnnccgaaagaguggc

SEQ ID NO: 4396 - RNA, 38 nt, Artificial Sequence
  Description of Artificial Sequence:  Enzymatic Nucleic Acid
  misc_feature (18)..(25): n stands for any nucleotide and can be optionally absent
acauugaccugaugaggnnnnnnnnccgaaauuagagu

SEQ ID NO: 4397 - RNA, 38 nt, Artificial Sequence
  Description of Artificial Sequence:  Enzymatic Nucleic Acid
  misc_feature (18)..(25): n stands for any nucleotide and can be optionally absent
uucacauucugaugaggnnnnnnnnccgaaacaauuag

SEQ ID NO: 4398 - RNA, 38 nt, Artificial Sequence
  Description of Artificial Sequence:  Enzymatic Nucleic Acid
  misc_feature (18)..(25): n stands for any nucleotide and can be optionally absent
uuuucguacugaugaggnnnnnnnnccgaaaucugggg

SEQ ID NO: 4399 - RNA, 38 nt, Artificial Sequence
  Description of Artificial Sequence:  Enzymatic Nucleic Acid
  misc_feature (18)..(25): n stands for any nucleotide and can be optionally absent
cuuuucgucugaugaggnnnnnnnnccgaaaaucuggg

SEQ ID NO: 4400 - RNA, 38 nt, Artificial Sequence
  Description of Artificial Sequence:  Enzymatic Nucleic Acid
  misc_feature (18)..(25): n stands for any nucleotide and can be optionally absent
ccuuuucgcugaugaggnnnnnnnnccgaaaaaucugg

SEQ ID NO: 4401 - RNA, 38 nt, Artificial Sequence
  Description of Artificial Sequence:  Enzymatic Nucleic Acid
  misc_feature (18)..(25): n stands for any nucleotide and can be optionally absent
gaaacgaucugaugaggnnnnnnnnccgaaacacggcc

SEQ ID NO: 4402 - RNA, 38 nt, Artificial Sequence
  Description of Artificial Sequence:  Enzymatic Nucleic Acid
  misc_feature (18)..(25): n stands for any nucleotide and can be optionally absent
cuggaaaccugaugaggnnnnnnnnccgaaaugacacg

SEQ ID NO: 4403 - RNA, 38 nt, Artificial Sequence
  Description of Artificial Sequence:  Enzymatic Nucleic Acid
  misc_feature (18)..(25): n stands for any nucleotide and can be optionally absent
ggucuggacugaugaggnnnnnnnnccgaaacgaugac

SEQ ID NO: 4404 - RNA, 38 nt, Artificial Sequence
  Description of Artificial Sequence:  Enzymatic Nucleic Acid
  misc_feature (18)..(25): n stands for any nucleotide and can be optionally absent
gggucuggcugaugaggnnnnnnnnccgaaaacgauga

SEQ ID NO: 4405 - RNA, 38 nt, Artificial Sequence
  Description of Artificial Sequence:  Enzymatic Nucleic Acid
  misc_feature (18)..(25): n stands for any nucleotide and can be optionally absent
cgggucugcugaugaggnnnnnnnnccgaaaaacgaug

SEQ ID NO: 4406 - RNA, 38 nt, Artificial Sequence
  Description of Artificial Sequence:  Enzymatic Nucleic Acid
  misc_feature (18)..(25): n stands for any nucleotide and can be optionally absent
uggguagacugaugaggnnnnnnnnccgaaagccgggu

SEQ ID NO: 4407 - RNA, 38 nt, Artificial Sequence
  Description of Artificial Sequence:  Enzymatic Nucleic Acid
  misc_feature (18)..(25): n stands for any nucleotide and can be optionally absent
aguggguacugaugaggnnnnnnnnccgaaagagccgg

SEQ ID NO: 4408 - RNA, 38 nt, Artificial Sequence
  Description of Artificial Sequence:  Enzymatic Nucleic Acid
  misc_feature (18)..(25): n stands for any nucleotide and can be optionally absent
ccagugggcugaugaggnnnnnnnnccgaaagagagcc

SEQ ID NO: 4409 - RNA, 38 nt, Artificial Sequence
  Description of Artificial Sequence:  Enzymatic Nucleic Acid
  misc_feature (18)..(25): n stands for any nucleotide and can be optionally absent
caagucagcugaugaggnnnnnnnnccgaaauuugucu

SEQ ID NO: 4410 - RNA, 38 nt, Artificial Sequence
  Description of Artificial Sequence:  Enzymatic Nucleic Acid
  misc_feature (18)..(25): n stands for any nucleotide and can be optionally absent
ugcgguaccugaugaggnnnnnnnnccgaaagucagga

SEQ ID NO: 4411 - RNA, 38 nt, Artificial Sequence
  Description of Artificial Sequence:  Enzymatic Nucleic Acid
  misc_feature (18)..(25): n stands for any nucleotide and can be optionally absent
auaugcggcugaugaggnnnnnnnnccgaaacaaguca

SEQ ID NO: 4412 - RNA, 38 nt, Artificial Sequence
  Description of Artificial Sequence:  Enzymatic Nucleic Acid
  misc_feature (18)..(25): n stands for any nucleotide and can be optionally absent
ggauaccacugaugaggnnnnnnnnccgaaaugcggua

SEQ ID NO: 4413 - RNA, 38 nt, Artificial Sequence
  Description of Artificial Sequence:  Enzymatic Nucleic Acid
  misc_feature (18)..(25): n stands for any nucleotide and can be optionally absent
uugagggacugaugaggnnnnnnnnccgaaaccauaug

SEQ ID NO: 4414 - RNA, 38 nt, Artificial Sequence
  Description of Artificial Sequence:  Enzymatic Nucleic Acid
  misc_feature (18)..(25): n stands for any nucleotide and can be optionally absent
gguugaggcugaugaggnnnnnnnnccgaaauaccaua

SEQ ID NO: 4415 - RNA, 38 nt, Artificial Sequence
  Description of Artificial Sequence:  Enzymatic Nucleic Acid
  misc_feature (18)..(25): n stands for any nucleotide and can be optionally absent
uguagguucugaugaggnnnnnnnnccgaaagggauac

SEQ ID NO: 4416 - RNA, 38 nt, Artificial Sequence
  Description of Artificial Sequence:  Enzymatic Nucleic Acid
  misc_feature (18)..(25): n stands for any nucleotide and can be optionally absent
cuugauugcugaugaggnnnnnnnnccgaaagguugag

SEQ ID NO: 4417 - RNA, 38 nt, Artificial Sequence
  Description of Artificial Sequence:  Enzymatic Nucleic Acid
  misc_feature (18)..(25): n stands for any nucleotide and can be optionally absent
aaccacuucugaugaggnnnnnnnnccgaaauuguagg

SEQ ID NO: 4418 - RNA, 38 nt, Artificial Sequence
  Description of Artificial Sequence:  Enzymatic Nucleic Acid
  misc_feature (18)..(25): n stands for any nucleotide and can be optionally absent
ggugccagcugaugaggnnnnnnnnccgaaaccacuug

SEQ ID NO: 4419 - RNA, 38 nt, Artificial Sequence
  Description of Artificial Sequence:  Enzymatic Nucleic Acid
  misc_feature (18)..(25): n stands for any nucleotide and can be optionally absent
gggugccacugaugaggnnnnnnnnccgaaaaccacuu

SEQ ID NO: 4420 - RNA, 38 nt, Artificial Sequence
  Description of Artificial Sequence:  Enzymatic Nucleic Acid
  misc_feature (18)..(25): n stands for any nucleotide and can be optionally absent
auuauggucugaugaggnnnnnnnnccgaaacaggggu

SEQ ID NO: 4421 - RNA, 38 nt, Artificial Sequence
  Description of Artificial Sequence:  Enzymatic Nucleic Acid
  misc_feature (18)..(25): n stands for any nucleotide and can be optionally absent
ggaaugaucugaugaggnnnnnnnnccgaaaugguuac

SEQ ID NO: 4422 - RNA, 38 nt, Artificial Sequence
  Description of Artificial Sequence:  Enzymatic Nucleic Acid
  misc_feature (18)..(25): n stands for any nucleotide and can be optionally absent
uucggaaucugaugaggnnnnnnnnccgaaauuauggu

SEQ ID NO: 4423 - RNA, 38 nt, Artificial Sequence
  Description of Artificial Sequence:  Enzymatic Nucleic Acid
  misc_feature (18)..(25): n stands for any nucleotide and can be optionally absent
ugcuucggcugaugaggnnnnnnnnccgaaaugauuau

SEQ ID NO: 4424 - RNA, 38 nt, Artificial Sequence
  Description of Artificial Sequence:  Enzymatic Nucleic Acid
  misc_feature (18)..(25): n stands for any nucleotide and can be optionally absent
uugcuucgcugaugaggnnnnnnnnccgaaaaugauua

SEQ ID NO: 4425 - RNA, 38 nt, Artificial Sequence
  Description of Artificial Sequence:  Enzymatic Nucleic Acid
  misc_feature (18)..(25): n stands for any nucleotide and can be optionally absent
uggaacaacugaugaggnnnnnnnnccgaaagucacac

SEQ ID NO: 4426 - RNA, 38 nt, Artificial Sequence
  Description of Artificial Sequence:  Enzymatic Nucleic Acid
  misc_feature (18)..(25): n stands for any nucleotide and can be optionally absent
uuggaacacugaugaggnnnnnnnnccgaaaagucaca

SEQ ID NO: 4427 - RNA, 38 nt, Artificial Sequence
  Description of Artificial Sequence:  Enzymatic Nucleic Acid
  misc_feature (18)..(25): n stands for any nucleotide and can be optionally absent
auuggaaccugaugaggnnnnnnnnccgaaaaagucac

SEQ ID NO: 4428 - RNA, 38 nt, Artificial Sequence
  Description of Artificial Sequence:  Enzymatic Nucleic Acid
  misc_feature (18)..(25): n stands for any nucleotide and can be optionally absent
auuauuggcugaugaggnnnnnnnnccgaaacaaaagu

SEQ ID NO: 4429 - RNA, 38 nt, Artificial Sequence
  Description of Artificial Sequence:  Enzymatic Nucleic Acid
  misc_feature (18)..(25): n stands for any nucleotide and can be optionally absent
cauuauugcugaugaggnnnnnnnnccgaaaacaaaag

SEQ ID NO: 4430 - RNA, 38 nt, Artificial Sequence
  Description of Artificial Sequence:  Enzymatic Nucleic Acid
  misc_feature (18)..(25): n stands for any nucleotide and can be optionally absent
cucuucaucugaugaggnnnnnnnnccgaaauuggaac

SEQ ID NO: 4431 - RNA, 38 nt, Artificial Sequence
  Description of Artificial Sequence:  Enzymatic Nucleic Acid
  misc_feature (18)..(25): n stands for any nucleotide and can be optionally absent
ggauaaagcugaugaggnnnnnnnnccgaaacucuuca

SEQ ID NO: 4432 - RNA, 38 nt, Artificial Sequence
  Description of Artificial Sequence:  Enzymatic Nucleic Acid
  misc_feature (18)..(25): n stands for any nucleotide and can be optionally absent
ccaggauacugaugaggnnnnnnnnccgaaaggacucu

SEQ ID NO: 4433 - RNA, 38 nt, Artificial Sequence
  Description of Artificial Sequence:  Enzymatic Nucleic Acid
  misc_feature (18)..(25): n stands for any nucleotide and can be optionally absent
uccaggaucugaugaggnnnnnnnnccgaaaaggacuc

SEQ ID NO: 4434 - RNA, 38 nt, Artificial Sequence
  Description of Artificial Sequence:  Enzymatic Nucleic Acid
  misc_feature (18)..(25): n stands for any nucleotide and can be optionally absent
auccaggacugaugaggnnnnnnnnccgaaaaaggacu

SEQ ID NO: 4435 - RNA, 38 nt, Artificial Sequence
  Description of Artificial Sequence:  Enzymatic Nucleic Acid
  misc_feature (18)..(25): n stands for any nucleotide and can be optionally absent
gcauccagcugaugaggnnnnnnnnccgaaauaaagga

SEQ ID NO: 4436 - RNA, 38 nt, Artificial Sequence
  Description of Artificial Sequence:  Enzymatic Nucleic Acid
  misc_feature (18)..(25): n stands for any nucleotide and can be optionally absent
augcucuccugaugaggnnnnnnnnccgaaauucuguu

SEQ ID NO: 4437 - RNA, 38 nt, Artificial Sequence
  Description of Artificial Sequence:  Enzymatic Nucleic Acid
  misc_feature (18)..(25): n stands for any nucleotide and can be optionally absent
cgcugagucugaugaggnnnnnnnnccgaaaugcucuc

SEQ ID NO: 4438 - RNA, 38 nt, Artificial Sequence
  Description of Artificial Sequence:  Enzymatic Nucleic Acid
  misc_feature (18)..(25): n stands for any nucleotide and can be optionally absent
caugcgcucugaugaggnnnnnnnnccgaaagugaugc

SEQ ID NO: 4439 - RNA, 38 nt, Artificial Sequence
  Description of Artificial Sequence:  Enzymatic Nucleic Acid
  misc_feature (18)..(25): n stands for any nucleotide and can be optionally absent
ccuucuaucugaugaggnnnnnnnnccgaaauugccau

SEQ ID NO: 4440 - RNA, 38 nt, Artificial Sequence
  Description of Artificial Sequence:  Enzymatic Nucleic Acid
  misc_feature (18)..(25): n stands for any nucleotide and can be optionally absent
uuuccuuccugaugaggnnnnnnnnccgaaauuauugc

SEQ ID NO: 4441 - RNA, 38 nt, Artificial Sequence
  Description of Artificial Sequence:  Enzymatic Nucleic Acid
  misc_feature (18)..(25): n stands for any nucleotide and can be optionally absent
agccaucucugaugaggnnnnnnnnccgaaauucuuuc

SEQ ID NO: 4442 - RNA, 38 nt, Artificial Sequence
  Description of Artificial Sequence:  Enzymatic Nucleic Acid
  misc_feature (18)..(25): n stands for any nucleotide and can be optionally absent
caaggugccugaugaggnnnnnnnnccgaaagccaucu

SEQ ID NO: 4443 - RNA, 38 nt, Artificial Sequence
  Description of Artificial Sequence:  Enzymatic Nucleic Acid
  misc_feature (18)..(25): n stands for any nucleotide and can be optionally absent
ccacaacccugaugaggnnnnnnnnccgaaaggugcua

SEQ ID NO: 4444 - RNA, 38 nt, Artificial Sequence
  Description of Artificial Sequence:  Enzymatic Nucleic Acid
  misc_feature (18)..(25): n stands for any nucleotide and can be optionally absent
ucagccaccugaugaggnnnnnnnnccgaaaccaaggu

SEQ ID NO: 4445 - RNA, 38 nt, Artificial Sequence
  Description of Artificial Sequence:  Enzymatic Nucleic Acid
  misc_feature (18)..(25): n stands for any nucleotide and can be optionally absent
aaauucuacugaugaggnnnnnnnnccgaaagucagcc

SEQ ID NO: 4446 - RNA, 38 nt, Artificial Sequence
  Description of Artificial Sequence:  Enzymatic Nucleic Acid
  misc_feature (18)..(25): n stands for any nucleotide and can be optionally absent
agaaauuccugaugaggnnnnnnnnccgaaagagucag

SEQ ID NO: 4447 - RNA, 38 nt, Artificial Sequence
  Description of Artificial Sequence:  Enzymatic Nucleic Acid
  misc_feature (18)..(25): n stands for any nucleotide and can be optionally absent
auuccagacugaugaggnnnnnnnnccgaaauucuaga

SEQ ID NO: 4448 - RNA, 38 nt, Artificial Sequence
  Description of Artificial Sequence:  Enzymatic Nucleic Acid
  misc_feature (18)..(25): n stands for any nucleotide and can be optionally absent
gauuccagcugaugaggnnnnnnnnccgaaaauucuag

SEQ ID NO: 4449 - RNA, 38 nt, Artificial Sequence
  Description of Artificial Sequence:  Enzymatic Nucleic Acid
  misc_feature (18)..(25): n stands for any nucleotide and can be optionally absent
agauuccacugaugaggnnnnnnnnccgaaaaauucua

SEQ ID NO: 4450 - RNA, 38 nt, Artificial Sequence
  Description of Artificial Sequence:  Enzymatic Nucleic Acid
  misc_feature (18)..(25): n stands for any nucleotide and can be optionally absent
caaauguacugaugaggnnnnnnnnccgaaauuccaga

SEQ ID NO: 4451 - RNA, 38 nt, Artificial Sequence
  Description of Artificial Sequence:  Enzymatic Nucleic Acid
  misc_feature (18)..(25): n stands for any nucleotide and can be optionally absent
ugcaaaugcugaugaggnnnnnnnnccgaaagauucca

SEQ ID NO: 4452 - RNA, 38 nt, Artificial Sequence
  Description of Artificial Sequence:  Enzymatic Nucleic Acid
  misc_feature (18)..(25): n stands for any nucleotide and can be optionally absent
gcuaugcacugaugaggnnnnnnnnccgaaauguagau

SEQ ID NO: 4453 - RNA, 38 nt, Artificial Sequence
  Description of Artificial Sequence:  Enzymatic Nucleic Acid
  misc_feature (18)..(25): n stands for any nucleotide and can be optionally absent
agcuaugccugaugaggnnnnnnnnccgaaaauguaga

SEQ ID NO: 4454 - RNA, 38 nt, Artificial Sequence
  Description of Artificial Sequence:  Enzymatic Nucleic Acid
  misc_feature (18)..(25): n stands for any nucleotide and can be optionally absent
uuggaagccugaugaggnnnnnnnnccgaaaugcaaau

SEQ ID NO: 4455 - RNA, 38 nt, Artificial Sequence
  Description of Artificial Sequence:  Enzymatic Nucleic Acid
  misc_feature (18)..(25): n stands for any nucleotide and can be optionally absent
uuuauuggcugaugaggnnnnnnnnccgaaagcuaugc

SEQ ID NO: 4456 - RNA, 38 nt, Artificial Sequence
  Description of Artificial Sequence:  Enzymatic Nucleic Acid
  misc_feature (18)..(25): n stands for any nucleotide and can be optionally absent
cuuuauugcugaugaggnnnnnnnnccgaaaagcuaug

SEQ ID NO: 4457 - RNA, 38 nt, Artificial Sequence
  Description of Artificial Sequence:  Enzymatic Nucleic Acid
  misc_feature (18)..(25): n stands for any nucleotide and can be optionally absent
cccaacuucugaugaggnnnnnnnnccgaaauuggaag

SEQ ID NO: 4458 - RNA, 38 nt, Artificial Sequence
  Description of Artificial Sequence:  Enzymatic Nucleic Acid
  misc_feature (18)..(25): n stands for any nucleotide and can be optionally absent
acaguccccugaugaggnnnnnnnnccgaaacuuuauu

SEQ ID NO: 4459 - RNA, 38 nt, Artificial Sequence
  Description of Artificial Sequence:  Enzymatic Nucleic Acid
  misc_feature (18)..(25): n stands for any nucleotide and can be optionally absent
uaaaagcucugaugaggnnnnnnnnccgaaauguuucu

SEQ ID NO: 4460 - RNA, 38 nt, Artificial Sequence
  Description of Artificial Sequence:  Enzymatic Nucleic Acid
  misc_feature (18)..(25): n stands for any nucleotide and can be optionally absent
ugauauaacugaugaggnnnnnnnnccgaaagcuuaug

SEQ ID NO: 4461 - RNA, 38 nt, Artificial Sequence
  Description of Artificial Sequence:  Enzymatic Nucleic Acid
  misc_feature (18)..(25): n stands for any nucleotide and can be optionally absent
gugauauacugaugaggnnnnnnnnccgaaaagcuuau

SEQ ID NO: 4462 - RNA, 38 nt, Artificial Sequence
  Description of Artificial Sequence:  Enzymatic Nucleic Acid
  misc_feature (18)..(25): n stands for any nucleotide and can be optionally absent
ugugauaucugaugaggnnnnnnnnccgaaaaagcuua

SEQ ID NO: 4463 - RNA, 38 nt, Artificial Sequence
  Description of Artificial Sequence:  Enzymatic Nucleic Acid
  misc_feature (18)..(25): n stands for any nucleotide and can be optionally absent
cugugauacugaugaggnnnnnnnnccgaaaaaagcuu

SEQ ID NO: 4464 - RNA, 38 nt, Artificial Sequence
  Description of Artificial Sequence:  Enzymatic Nucleic Acid
  misc_feature (18)..(25): n stands for any nucleotide and can be optionally absent
aucugugacugaugaggnnnnnnnnccgaaauaaaagc

SEQ ID NO: 4465 - RNA, 38 nt, Artificial Sequence
  Description of Artificial Sequence:  Enzymatic Nucleic Acid
  misc_feature (18)..(25): n stands for any nucleotide and can be optionally absent
acaucugucugaugaggnnnnnnnnccgaaauauaaaa

SEQ ID NO: 4466 - RNA, 38 nt, Artificial Sequence
  Description of Artificial Sequence:  Enzymatic Nucleic Acid
  misc_feature (18)..(25): n stands for any nucleotide and can be optionally absent
uaacaugacugaugaggnnnnnnnnccgaaacccauuu

SEQ ID NO: 4467 - RNA, 38 nt, Artificial Sequence
  Description of Artificial Sequence:  Enzymatic Nucleic Acid
  misc_feature (18)..(25): n stands for any nucleotide and can be optionally absent
uuaacaugcugaugaggnnnnnnnnccgaaaacccauu

SEQ ID NO: 4468 - RNA, 38 nt, Artificial Sequence
  Description of Artificial Sequence:  Enzymatic Nucleic Acid
  misc_feature (18)..(25): n stands for any nucleotide and can be optionally absent
guuaacaucugaugaggnnnnnnnnccgaaaaacccau

SEQ ID NO: 4469 - RNA, 38 nt, Artificial Sequence
  Description of Artificial Sequence:  Enzymatic Nucleic Acid
  misc_feature (18)..(25): n stands for any nucleotide and can be optionally absent
uccaaguucugaugaggnnnnnnnnccgaaacaugaaa

SEQ ID NO: 4470 - RNA, 38 nt, Artificial Sequence
  Description of Artificial Sequence:  Enzymatic Nucleic Acid
  misc_feature (18)..(25): n stands for any nucleotide and can be optionally absent
uuccaagucugaugaggnnnnnnnnccgaaaacaugaa

SEQ ID NO: 4471 - RNA, 38 nt, Artificial Sequence
  Description of Artificial Sequence:  Enzymatic Nucleic Acid
  misc_feature (18)..(25): n stands for any nucleotide and can be optionally absent
uuuuuucccugaugaggnnnnnnnnccgaaaguuaaca

SEQ ID NO: 4472 - RNA, 38 nt, Artificial Sequence
  Description of Artificial Sequence:  Enzymatic Nucleic Acid
  misc_feature (18)..(25): n stands for any nucleotide and can be optionally absent
cugugcaacugaugaggnnnnnnnnccgaaacaguuuc

SEQ ID NO: 4473 - RNA, 38 nt, Artificial Sequence
  Description of Artificial Sequence:  Enzymatic Nucleic Acid
  misc_feature (18)..(25): n stands for any nucleotide and can be optionally absent
aacugugccugaugaggnnnnnnnnccgaaagacaguu

SEQ ID NO: 4474 - RNA, 38 nt, Artificial Sequence
  Description of Artificial Sequence:  Enzymatic Nucleic Acid
  misc_feature (18)..(25): n stands for any nucleotide and can be optionally absent
aacuuguucugaugaggnnnnnnnnccgaaacugugca

SEQ ID NO: 4475 - RNA, 38 nt, Artificial Sequence
  Description of Artificial Sequence:  Enzymatic Nucleic Acid
  misc_feature (18)..(25): n stands for any nucleotide and can be optionally absent
gaacuugucugaugaggnnnnnnnnccgaaaacugugc

SEQ ID NO: 4476 - RNA, 38 nt, Artificial Sequence
  Description of Artificial Sequence:  Enzymatic Nucleic Acid
  misc_feature (18)..(25): n stands for any nucleotide and can be optionally absent
uguauaagcugaugaggnnnnnnnnccgaaacuuguua

SEQ ID NO: 4477 - RNA, 38 nt, Artificial Sequence
  Description of Artificial Sequence:  Enzymatic Nucleic Acid
  misc_feature (18)..(25): n stands for any nucleotide and can be optionally absent
cuguauaacugaugaggnnnnnnnnccgaaaacuuguu

SEQ ID NO: 4478 - RNA, 38 nt, Artificial Sequence
  Description of Artificial Sequence:  Enzymatic Nucleic Acid
  misc_feature (18)..(25): n stands for any nucleotide and can be optionally absent
cucuguaucugaugaggnnnnnnnnccgaaagaacuug

SEQ ID NO: 4479 - RNA, 38 nt, Artificial Sequence
  Description of Artificial Sequence:  Enzymatic Nucleic Acid
  misc_feature (18)..(25): n stands for any nucleotide and can be optionally absent
ucucuguacugaugaggnnnnnnnnccgaaaagaacuu

SEQ ID NO: 4480 - RNA, 38 nt, Artificial Sequence
  Description of Artificial Sequence:  Enzymatic Nucleic Acid
  misc_feature (18)..(25): n stands for any nucleotide and can be optionally absent
cgucucugcugaugaggnnnnnnnnccgaaauaagaac

SEQ ID NO: 4481 - RNA, 38 nt, Artificial Sequence
  Description of Artificial Sequence:  Enzymatic Nucleic Acid
  misc_feature (18)..(25): n stands for any nucleotide and can be optionally absent
auccaagucugaugaggnnnnnnnnccgaaacgucucu

SEQ ID NO: 4482 - RNA, 38 nt, Artificial Sequence
  Description of Artificial Sequence:  Enzymatic Nucleic Acid
  misc_feature (18)..(25): n stands for any nucleotide and can be optionally absent
aauccaagcugaugaggnnnnnnnnccgaaaacgucuc

SEQ ID NO: 4483 - RNA, 38 nt, Artificial Sequence
  Description of Artificial Sequence:  Enzymatic Nucleic Acid
  misc_feature (18)..(25): n stands for any nucleotide and can be optionally absent
uaaaaucccugaugaggnnnnnnnnccgaaaguaacgu

SEQ ID NO: 4484 - RNA, 38 nt, Artificial Sequence
  Description of Artificial Sequence:  Enzymatic Nucleic Acid
  misc_feature (18)..(25): n stands for any nucleotide and can be optionally absent
cgcaguaacugaugaggnnnnnnnnccgaaauccaagu

SEQ ID NO: 4485 - RNA, 38 nt, Artificial Sequence
  Description of Artificial Sequence:  Enzymatic Nucleic Acid
  misc_feature (18)..(25): n stands for any nucleotide and can be optionally absent
ccgcaguacugaugaggnnnnnnnnccgaaaauccaag

SEQ ID NO: 4486 - RNA, 38 nt, Artificial Sequence
  Description of Artificial Sequence:  Enzymatic Nucleic Acid
  misc_feature (18)..(25): n stands for any nucleotide and can be optionally absent
uccgcagucugaugaggnnnnnnnnccgaaaaauccaa

SEQ ID NO: 4487 - RNA, 38 nt, Artificial Sequence
  Description of Artificial Sequence:  Enzymatic Nucleic Acid
  misc_feature (18)..(25): n stands for any nucleotide and can be optionally absent
guccgcagcugaugaggnnnnnnnnccgaaaaaaucca

SEQ ID NO: 4488 - RNA, 38 nt, Artificial Sequence
  Description of Artificial Sequence:  Enzymatic Nucleic Acid
  misc_feature (18)..(25): n stands for any nucleotide and can be optionally absent
cuguuauucugaugaggnnnnnnnnccgaaacuguccg

SEQ ID NO: 4489 - RNA, 38 nt, Artificial Sequence
  Description of Artificial Sequence:  Enzymatic Nucleic Acid
  misc_feature (18)..(25): n stands for any nucleotide and can be optionally absent
ucuguuaucugaugaggnnnnnnnnccgaaaacugucc

SEQ ID NO: 4490 - RNA, 38 nt, Artificial Sequence
  Description of Artificial Sequence:  Enzymatic Nucleic Acid
  misc_feature (18)..(25): n stands for any nucleotide and can be optionally absent
uguucugucugaugaggnnnnnnnnccgaaauuaacug

SEQ ID NO: 4491 - RNA, 38 nt, Artificial Sequence
  Description of Artificial Sequence:  Enzymatic Nucleic Acid
  misc_feature (18)..(25): n stands for any nucleotide and can be optionally absent
uaauacugcugaugaggnnnnnnnnccgaaagugcauu

SEQ ID NO: 4492 - RNA, 38 nt, Artificial Sequence
  Description of Artificial Sequence:  Enzymatic Nucleic Acid
  misc_feature (18)..(25): n stands for any nucleotide and can be optionally absent
cuugcuaacugaugaggnnnnnnnnccgaaacuguagu

SEQ ID NO: 4493 - RNA, 38 nt, Artificial Sequence
  Description of Artificial Sequence:  Enzymatic Nucleic Acid
  misc_feature (18)..(25): n stands for any nucleotide and can be optionally absent
ugcuugcucugaugaggnnnnnnnnccgaaauacugua

SEQ ID NO: 4494 - RNA, 38 nt, Artificial Sequence
  Description of Artificial Sequence:  Enzymatic Nucleic Acid
  misc_feature (18)..(25): n stands for any nucleotide and can be optionally absent
uugcuugccugaugaggnnnnnnnnccgaaaauacugu

SEQ ID NO: 4495 - RNA, 38 nt, Artificial Sequence
  Description of Artificial Sequence:  Enzymatic Nucleic Acid
  misc_feature (18)..(25): n stands for any nucleotide and can be optionally absent
uccuuagucugaugaggnnnnnnnnccgaaauggccau

SEQ ID NO: 4496 - RNA, 38 nt, Artificial Sequence
  Description of Artificial Sequence:  Enzymatic Nucleic Acid
  misc_feature (18)..(25): n stands for any nucleotide and can be optionally absent
gugcuccucugaugaggnnnnnnnnccgaaagugaugg

SEQ ID NO: 4497 - RNA, 38 nt, Artificial Sequence
  Description of Artificial Sequence:  Enzymatic Nucleic Acid
  misc_feature (18)..(25): n stands for any nucleotide and can be optionally absent
gagugaugcugaugaggnnnnnnnnccgaaagugcucc

SEQ ID NO: 4498 - RNA, 38 nt, Artificial Sequence
  Description of Artificial Sequence:  Enzymatic Nucleic Acid
  misc_feature (18)..(25): n stands for any nucleotide and can be optionally absent
uuaagagucugaugaggnnnnnnnnccgaaauggagug

SEQ ID NO: 4499 - RNA, 38 nt, Artificial Sequence
  Description of Artificial Sequence:  Enzymatic Nucleic Acid
  misc_feature (18)..(25): n stands for any nucleotide and can be optionally absent
aagauuaacugaugaggnnnnnnnnccgaaagugaugg

SEQ ID NO: 4500 - RNA, 38 nt, Artificial Sequence
  Description of Artificial Sequence:  Enzymatic Nucleic Acid
  misc_feature (18)..(25): n stands for any nucleotide and can be optionally absent
guaagauucugaugaggnnnnnnnnccgaaagagugau

SEQ ID NO: 4501 - RNA, 38 nt, Artificial Sequence
  Description of Artificial Sequence:  Enzymatic Nucleic Acid
  misc_feature (18)..(25): n stands for any nucleotide and can be optionally absent
gguaagaucugaugaggnnnnnnnnccgaaaagaguga

SEQ ID NO: 4502 - RNA, 38 nt, Artificial Sequence
  Description of Artificial Sequence:  Enzymatic Nucleic Acid
  misc_feature (18)..(25): n stands for any nucleotide and can be optionally absent
gaugguaacugaugaggnnnnnnnnccgaaauuaagag

SEQ ID NO: 4503 - RNA, 38 nt, Artificial Sequence
  Description of Artificial Sequence:  Enzymatic Nucleic Acid
  misc_feature (18)..(25): n stands for any nucleotide and can be optionally absent
augauggucugaugaggnnnnnnnnccgaaagauuaag

SEQ ID NO: 4504 - RNA, 38 nt, Artificial Sequence
  Description of Artificial Sequence:  Enzymatic Nucleic Acid
  misc_feature (18)..(25): n stands for any nucleotide and can be optionally absent
caugauggcugaugaggnnnnnnnnccgaaaagauuaa

SEQ ID NO: 4505 - RNA, 38 nt, Artificial Sequence
  Description of Artificial Sequence:  Enzymatic Nucleic Acid
  misc_feature (18)..(25): n stands for any nucleotide and can be optionally absent
acauucaucugaugaggnnnnnnnnccgaaaugguaag

SEQ ID NO: 4506 - RNA, 38 nt, Artificial Sequence
  Description of Artificial Sequence:  Enzymatic Nucleic Acid
  misc_feature (18)..(25): n stands for any nucleotide and can be optionally absent
ugcagggacugaugaggnnnnnnnnccgaaacauucau

SEQ ID NO: 4507 - RNA, 38 nt, Artificial Sequence
  Description of Artificial Sequence:  Enzymatic Nucleic Acid
  misc_feature (18)..(25): n stands for any nucleotide and can be optionally absent
uugcagggcugaugaggnnnnnnnnccgaaaacauuca

SEQ ID NO: 4508 - RNA, 38 nt, Artificial Sequence
  Description of Artificial Sequence:  Enzymatic Nucleic Acid
  misc_feature (18)..(25): n stands for any nucleotide and can be optionally absent
cuugcaggcugaugaggnnnnnnnnccgaaaaacauuc

SEQ ID NO: 4509 - RNA, 38 nt, Artificial Sequence
  Description of Artificial Sequence:  Enzymatic Nucleic Acid
  misc_feature (18)..(25): n stands for any nucleotide and can be optionally absent
ggugccugcugaugaggnnnnnnnnccgaaaucuugca

SEQ ID NO: 4510 - RNA, 38 nt, Artificial Sequence
  Description of Artificial Sequence:  Enzymatic Nucleic Acid
  misc_feature (18)..(25): n stands for any nucleotide and can be optionally absent
aggugccucugaugaggnnnnnnnnccgaaaaucuugc

SEQ ID NO: 4511 - RNA, 38 nt, Artificial Sequence
  Description of Artificial Sequence:  Enzymatic Nucleic Acid
  misc_feature (18)..(25): n stands for any nucleotide and can be optionally absent
ugcaggcacugaugaggnnnnnnnnccgaaaggugccu

SEQ ID NO: 4512 - RNA, 38 nt, Artificial Sequence
  Description of Artificial Sequence:  Enzymatic Nucleic Acid
  misc_feature (18)..(25): n stands for any nucleotide and can be optionally absent
ccuguguacugaugaggnnnnnnnnccgaaacauuccu

SEQ ID NO: 4513 - RNA, 38 nt, Artificial Sequence
  Description of Artificial Sequence:  Enzymatic Nucleic Acid
  misc_feature (18)..(25): n stands for any nucleotide and can be optionally absent
ccccugugcugaugaggnnnnnnnnccgaaauacauuc

SEQ ID NO: 4514 - RNA, 38 nt, Artificial Sequence
  Description of Artificial Sequence:  Enzymatic Nucleic Acid
  misc_feature (18)..(25): n stands for any nucleotide and can be optionally absent
uucuggagcugaugaggnnnnnnnnccgaaauuucuuc

SEQ ID NO: 4515 - RNA, 38 nt, Artificial Sequence
  Description of Artificial Sequence:  Enzymatic Nucleic Acid
  misc_feature (18)..(25): n stands for any nucleotide and can be optionally absent
uucuucugcugaugaggnnnnnnnnccgaaaggauuuc

SEQ ID NO: 4516 - RNA, 38 nt, Artificial Sequence
  Description of Artificial Sequence:  Enzymatic Nucleic Acid
  misc_feature (18)..(25): n stands for any nucleotide and can be optionally absent
cugauugucugaugaggnnnnnnnnccgaaauuucuuu

SEQ ID NO: 4517 - RNA, 38 nt, Artificial Sequence
  Description of Artificial Sequence:  Enzymatic Nucleic Acid
  misc_feature (18)..(25): n stands for any nucleotide and can be optionally absent
ucugauugcugaugaggnnnnnnnnccgaaaauuucuu

SEQ ID NO: 4518 - RNA, 38 nt, Artificial Sequence
  Description of Artificial Sequence:  Enzymatic Nucleic Acid
  misc_feature (18)..(25): n stands for any nucleotide and can be optionally absent
ugaucucucugaugaggnnnnnnnnccgaaauuguaau

SEQ ID NO: 4519 - RNA, 38 nt, Artificial Sequence
  Description of Artificial Sequence:  Enzymatic Nucleic Acid
  misc_feature (18)..(25): n stands for any nucleotide and can be optionally absent
ugcuuccucugaugaggnnnnnnnnccgaaaucucuga

SEQ ID NO: 4520 - RNA, 38 nt, Artificial Sequence
  Description of Artificial Sequence:  Enzymatic Nucleic Acid
  misc_feature (18)..(25): n stands for any nucleotide and can be optionally absent
gcaggaggcugaugaggnnnnnnnnccgaaauggugcu

SEQ ID NO: 4521 - RNA, 38 nt, Artificial Sequence
  Description of Artificial Sequence:  Enzymatic Nucleic Acid
  misc_feature (18)..(25): n stands for any nucleotide and can be optionally absent
uuucgcagcugaugaggnnnnnnnnccgaaagguaugg

SEQ ID NO: 4522 - RNA, 38 nt, Artificial Sequence
  Description of Artificial Sequence:  Enzymatic Nucleic Acid
  misc_feature (18)..(25): n stands for any nucleotide and can be optionally absent
ugaucacucugaugaggnnnnnnnnccgaaagguuucg

SEQ ID NO: 4523 - RNA, 38 nt, Artificial Sequence
  Description of Artificial Sequence:  Enzymatic Nucleic Acid
  misc_feature (18)..(25): n stands for any nucleotide and can be optionally absent
cacugugucugaugaggnnnnnnnnccgaaaucacuga

SEQ ID NO: 4524 - RNA, 38 nt, Artificial Sequence
  Description of Artificial Sequence:  Enzymatic Nucleic Acid
  misc_feature (18)..(25): n stands for any nucleotide and can be optionally absent
gaacugcucugaugaggnnnnnnnnccgaaauggccac

SEQ ID NO: 4525 - RNA, 38 nt, Artificial Sequence
  Description of Artificial Sequence:  Enzymatic Nucleic Acid
  misc_feature (18)..(25): n stands for any nucleotide and can be optionally absent
agugguggcugaugaggnnnnnnnnccgaaacugcuga

SEQ ID NO: 4526 - RNA, 38 nt, Artificial Sequence
  Description of Artificial Sequence:  Enzymatic Nucleic Acid
  misc_feature (18)..(25): n stands for any nucleotide and can be optionally absent
aaguggugcugaugaggnnnnnnnnccgaaaacugcug

SEQ ID NO: 4527 - RNA, 38 nt, Artificial Sequence
  Description of Artificial Sequence:  Enzymatic Nucleic Acid
  misc_feature (18)..(25): n stands for any nucleotide and can be optionally absent
acagucuacugaugaggnnnnnnnnccgaaaguggugg

SEQ ID NO: 4528 - RNA, 38 nt, Artificial Sequence
  Description of Artificial Sequence:  Enzymatic Nucleic Acid
  misc_feature (18)..(25): n stands for any nucleotide and can be optionally absent
gacagucucugaugaggnnnnnnnnccgaaaaguggug

SEQ ID NO: 4529 - RNA, 38 nt, Artificial Sequence
  Description of Artificial Sequence:  Enzymatic Nucleic Acid
  misc_feature (18)..(25): n stands for any nucleotide and can be optionally absent
ugacaguccugaugaggnnnnnnnnccgaaaaaguggu

SEQ ID NO: 4530 - RNA, 38 nt, Artificial Sequence
  Description of Artificial Sequence:  Enzymatic Nucleic Acid
  misc_feature (18)..(25): n stands for any nucleotide and can be optionally absent
auuagcaucugaugaggnnnnnnnnccgaaacagucua

SEQ ID NO: 4531 - RNA, 38 nt, Artificial Sequence
  Description of Artificial Sequence:  Enzymatic Nucleic Acid
  misc_feature (18)..(25): n stands for any nucleotide and can be optionally absent
gacaccaucugaugaggnnnnnnnnccgaaagcaugac

SEQ ID NO: 4532 - RNA, 38 nt, Artificial Sequence
  Description of Artificial Sequence:  Enzymatic Nucleic Acid
  misc_feature (18)..(25): n stands for any nucleotide and can be optionally absent
ggcucgggcugaugaggnnnnnnnnccgaaacaccauu

SEQ ID NO: 4533 - RNA, 38 nt, Artificial Sequence
  Description of Artificial Sequence:  Enzymatic Nucleic Acid
  misc_feature (18)..(25): n stands for any nucleotide and can be optionally absent
agugaucucugaugaggnnnnnnnnccgaaaggcucgg

SEQ ID NO: 4534 - RNA, 38 nt, Artificial Sequence
  Description of Artificial Sequence:  Enzymatic Nucleic Acid
  misc_feature (18)..(25): n stands for any nucleotide and can be optionally absent
aaccaagucugaugaggnnnnnnnnccgaaaucugagg

SEQ ID NO: 4535 - RNA, 38 nt, Artificial Sequence
  Description of Artificial Sequence:  Enzymatic Nucleic Acid
  misc_feature (18)..(25): n stands for any nucleotide and can be optionally absent
uuuaaacccugaugaggnnnnnnnnccgaaagugaucu

SEQ ID NO: 4536 - RNA, 38 nt, Artificial Sequence
  Description of Artificial Sequence:  Enzymatic Nucleic Acid
  misc_feature (18)..(25): n stands for any nucleotide and can be optionally absent
uguuuuuacugaugaggnnnnnnnnccgaaaccaagug

SEQ ID NO: 4537 - RNA, 38 nt, Artificial Sequence
  Description of Artificial Sequence:  Enzymatic Nucleic Acid
  misc_feature (18)..(25): n stands for any nucleotide and can be optionally absent
uuguuuuucugaugaggnnnnnnnnccgaaaaccaagu

SEQ ID NO: 4538 - RNA, 38 nt, Artificial Sequence
  Description of Artificial Sequence:  Enzymatic Nucleic Acid
  misc_feature (18)..(25): n stands for any nucleotide and can be optionally absent
guuguuuucugaugaggnnnnnnnnccgaaaaaccaag

SEQ ID NO: 4539 - RNA, 38 nt, Artificial Sequence
  Description of Artificial Sequence:  Enzymatic Nucleic Acid
  misc_feature (18)..(25): n stands for any nucleotide and can be optionally absent
ucuuguugcugaugaggnnnnnnnnccgaaauuuugug

SEQ ID NO: 4540 - RNA, 38 nt, Artificial Sequence
  Description of Artificial Sequence:  Enzymatic Nucleic Acid
  misc_feature (18)..(25): n stands for any nucleotide and can be optionally absent
ccuaaaaucugaugaggnnnnnnnnccgaaauuccagg

SEQ ID NO: 4541 - RNA, 38 nt, Artificial Sequence
  Description of Artificial Sequence:  Enzymatic Nucleic Acid
  misc_feature (18)..(25): n stands for any nucleotide and can be optionally absent
uccuaaaacugaugaggnnnnnnnnccgaaaauuccag

SEQ ID NO: 4542 - RNA, 38 nt, Artificial Sequence
  Description of Artificial Sequence:  Enzymatic Nucleic Acid
  misc_feature (18)..(25): n stands for any nucleotide and can be optionally absent
gguccuaacugaugaggnnnnnnnnccgaaauaauucc

SEQ ID NO: 4543 - RNA, 38 nt, Artificial Sequence
  Description of Artificial Sequence:  Enzymatic Nucleic Acid
  misc_feature (18)..(25): n stands for any nucleotide and can be optionally absent
ugguccuacugaugaggnnnnnnnnccgaaaauaauuc

SEQ ID NO: 4544 - RNA, 38 nt, Artificial Sequence
  Description of Artificial Sequence:  Enzymatic Nucleic Acid
  misc_feature (18)..(25): n stands for any nucleotide and can be optionally absent
cugguccucugaugaggnnnnnnnnccgaaaaauaauu

SEQ ID NO: 4545 - RNA, 38 nt, Artificial Sequence
  Description of Artificial Sequence:  Enzymatic Nucleic Acid
  misc_feature (18)..(25): n stands for any nucleotide and can be optionally absent
ccuggucccugaugaggnnnnnnnnccgaaaaaauaau

SEQ ID NO: 4546 - RNA, 38 nt, Artificial Sequence
  Description of Artificial Sequence:  Enzymatic Nucleic Acid
  misc_feature (18)..(25): n stands for any nucleotide and can be optionally absent
uuucaauacugaugaggnnnnnnnnccgaaacagcgug

SEQ ID NO: 4547 - RNA, 38 nt, Artificial Sequence
  Description of Artificial Sequence:  Enzymatic Nucleic Acid
  misc_feature (18)..(25): n stands for any nucleotide and can be optionally absent
cuuucaaucugaugaggnnnnnnnnccgaaaacagcgu

SEQ ID NO: 4548 - RNA, 38 nt, Artificial Sequence
  Description of Artificial Sequence:  Enzymatic Nucleic Acid
  misc_feature (18)..(25): n stands for any nucleotide and can be optionally absent
ucuuucaacugaugaggnnnnnnnnccgaaaaacagcg

SEQ ID NO: 4549 - RNA, 38 nt, Artificial Sequence
  Description of Artificial Sequence:  Enzymatic Nucleic Acid
  misc_feature (18)..(25): n stands for any nucleotide and can be optionally absent
acucuuuccugaugaggnnnnnnnnccgaaauaaacag

SEQ ID NO: 4550 - RNA, 38 nt, Artificial Sequence
  Description of Artificial Sequence:  Enzymatic Nucleic Acid
  misc_feature (18)..(25): n stands for any nucleotide and can be optionally absent
ucuucugucugaugaggnnnnnnnnccgaaacucuuuc

SEQ ID NO: 4551 - RNA, 38 nt, Artificial Sequence
  Description of Artificial Sequence:  Enzymatic Nucleic Acid
  misc_feature (18)..(25): n stands for any nucleotide and can be optionally absent
cagugauacugaugaggnnnnnnnnccgaaacaccuuc

SEQ ID NO: 4552 - RNA, 38 nt, Artificial Sequence
  Description of Artificial Sequence:  Enzymatic Nucleic Acid
  misc_feature (18)..(25): n stands for any nucleotide and can be optionally absent
ugcagugacugaugaggnnnnnnnnccgaaagacaccu

SEQ ID NO: 4553 - RNA, 38 nt, Artificial Sequence
  Description of Artificial Sequence:  Enzymatic Nucleic Acid
  misc_feature (18)..(25): n stands for any nucleotide and can be optionally absent
uuugcagucugaugaggnnnnnnnnccgaaauagacac

SEQ ID NO: 4554 - RNA, 38 nt, Artificial Sequence
  Description of Artificial Sequence:  Enzymatic Nucleic Acid
  misc_feature (18)..(25): n stands for any nucleotide and can be optionally absent
uuuccacacugaugaggnnnnnnnnccgaaagcccuuc

SEQ ID NO: 4555 - RNA, 38 nt, Artificial Sequence
  Description of Artificial Sequence:  Enzymatic Nucleic Acid
  misc_feature (18)..(25): n stands for any nucleotide and can be optionally absent
guaugcugcugaugaggnnnnnnnnccgaaacuuucca

SEQ ID NO: 4556 - RNA, 38 nt, Artificial Sequence
  Description of Artificial Sequence:  Enzymatic Nucleic Acid
  misc_feature (18)..(25): n stands for any nucleotide and can be optionally absent
gguaugcucugaugaggnnnnnnnnccgaaaacuuucc

SEQ ID NO: 4557 - RNA, 38 nt, Artificial Sequence
  Description of Artificial Sequence:  Enzymatic Nucleic Acid
  misc_feature (18)..(25): n stands for any nucleotide and can be optionally absent
cagugaggcugaugaggnnnnnnnnccgaaaugcugaa

SEQ ID NO: 4558 - RNA, 38 nt, Artificial Sequence
  Description of Artificial Sequence:  Enzymatic Nucleic Acid
  misc_feature (18)..(25): n stands for any nucleotide and can be optionally absent
ugaacagucugaugaggnnnnnnnnccgaaagguaugc

SEQ ID NO: 4559 - RNA, 38 nt, Artificial Sequence
  Description of Artificial Sequence:  Enzymatic Nucleic Acid
  misc_feature (18)..(25): n stands for any nucleotide and can be optionally absent
guuccuugcugaugaggnnnnnnnnccgaaacagugag

SEQ ID NO: 4560 - RNA, 38 nt, Artificial Sequence
  Description of Artificial Sequence:  Enzymatic Nucleic Acid
  misc_feature (18)..(25): n stands for any nucleotide and can be optionally absent
gguuccuucugaugaggnnnnnnnnccgaaaacaguga

SEQ ID NO: 4561 - RNA, 38 nt, Artificial Sequence
  Description of Artificial Sequence:  Enzymatic Nucleic Acid
  misc_feature (18)..(25): n stands for any nucleotide and can be optionally absent
acuugucccugaugaggnnnnnnnnccgaaagguuccu

SEQ ID NO: 4562 - RNA, 38 nt, Artificial Sequence
  Description of Artificial Sequence:  Enzymatic Nucleic Acid
  misc_feature (18)..(25): n stands for any nucleotide and can be optionally absent
ccagauuacugaugaggnnnnnnnnccgaaacuugucc

SEQ ID NO: 4563 - RNA, 38 nt, Artificial Sequence
  Description of Artificial Sequence:  Enzymatic Nucleic Acid
  misc_feature (18)..(25): n stands for any nucleotide and can be optionally absent
cuccagaucugaugaggnnnnnnnnccgaaagacuugu

SEQ ID NO: 4564 - RNA, 38 nt, Artificial Sequence
  Description of Artificial Sequence:  Enzymatic Nucleic Acid
  misc_feature (18)..(25): n stands for any nucleotide and can be optionally absent
cagcuccacugaugaggnnnnnnnnccgaaauuagacu

SEQ ID NO: 4565 - RNA, 38 nt, Artificial Sequence
  Description of Artificial Sequence:  Enzymatic Nucleic Acid
  misc_feature (18)..(25): n stands for any nucleotide and can be optionally absent
guuagagucugaugaggnnnnnnnnccgaaaucagcuc

SEQ ID NO: 4566 - RNA, 38 nt, Artificial Sequence
  Description of Artificial Sequence:  Enzymatic Nucleic Acid
  misc_feature (18)..(25): n stands for any nucleotide and can be optionally absent
gcauguuacugaugaggnnnnnnnnccgaaagugauca

SEQ ID NO: 4567 - RNA, 38 nt, Artificial Sequence
  Description of Artificial Sequence:  Enzymatic Nucleic Acid
  misc_feature (18)..(25): n stands for any nucleotide and can be optionally absent
gugcaugucugaugaggnnnnnnnnccgaaagagugau

SEQ ID NO: 4568 - RNA, 38 nt, Artificial Sequence
  Description of Artificial Sequence:  Enzymatic Nucleic Acid
  misc_feature (18)..(25): n stands for any nucleotide and can be optionally absent
ccagaagacugaugaggnnnnnnnnccgaaagucgcag

SEQ ID NO: 4569 - RNA, 38 nt, Artificial Sequence
  Description of Artificial Sequence:  Enzymatic Nucleic Acid
  misc_feature (18)..(25): n stands for any nucleotide and can be optionally absent
agccagaacugaugaggnnnnnnnnccgaaagagucgc

SEQ ID NO: 4570 - RNA, 38 nt, Artificial Sequence
  Description of Artificial Sequence:  Enzymatic Nucleic Acid
  misc_feature (18)..(25): n stands for any nucleotide and can be optionally absent
ggagccagcugaugaggnnnnnnnnccgaaagagaguc

SEQ ID NO: 4571 - RNA, 38 nt, Artificial Sequence
  Description of Artificial Sequence:  Enzymatic Nucleic Acid
  misc_feature (18)..(25): n stands for any nucleotide and can be optionally absent
aggagccacugaugaggnnnnnnnnccgaaaagagagu

SEQ ID NO: 4572 - RNA, 38 nt, Artificial Sequence
  Description of Artificial Sequence:  Enzymatic Nucleic Acid
  misc_feature (18)..(25): n stands for any nucleotide and can be optionally absent
guuaauagcugaugaggnnnnnnnnccgaaagccagaa

SEQ ID NO: 4573 - RNA, 38 nt, Artificial Sequence
  Description of Artificial Sequence:  Enzymatic Nucleic Acid
  misc_feature (18)..(25): n stands for any nucleotide and can be optionally absent
aggguuaacugaugaggnnnnnnnnccgaaaggagcca

SEQ ID NO: 4574 - RNA, 38 nt, Artificial Sequence
  Description of Artificial Sequence:  Enzymatic Nucleic Acid
  misc_feature (18)..(25): n stands for any nucleotide and can be optionally absent
ggaggguucugaugaggnnnnnnnnccgaaauaggagc

SEQ ID NO: 4575 - RNA, 38 nt, Artificial Sequence
  Description of Artificial Sequence:  Enzymatic Nucleic Acid
  misc_feature (18)..(25): n stands for any nucleotide and can be optionally absent
aggagggucugaugaggnnnnnnnnccgaaaauaggag

SEQ ID NO: 4576 - RNA, 38 nt, Artificial Sequence
  Description of Artificial Sequence:  Enzymatic Nucleic Acid
  misc_feature (18)..(25): n stands for any nucleotide and can be optionally absent
cggauaagcugaugaggnnnnnnnnccgaaaggguuaa

SEQ ID NO: 4577 - RNA, 38 nt, Artificial Sequence
  Description of Artificial Sequence:  Enzymatic Nucleic Acid
  misc_feature (18)..(25): n stands for any nucleotide and can be optionally absent
uuucggaucugaugaggnnnnnnnnccgaaaggagggu

SEQ ID NO: 4578 - RNA, 38 nt, Artificial Sequence
  Description of Artificial Sequence:  Enzymatic Nucleic Acid
  misc_feature (18)..(25): n stands for any nucleotide and can be optionally absent
uuuucggacugaugaggnnnnnnnnccgaaaaggaggg

SEQ ID NO: 4579 - RNA, 38 nt, Artificial Sequence
  Description of Artificial Sequence:  Enzymatic Nucleic Acid
  misc_feature (18)..(25): n stands for any nucleotide and can be optionally absent
auuuuucgcugaugaggnnnnnnnnccgaaauaaggag

SEQ ID NO: 4580 - RNA, 38 nt, Artificial Sequence
  Description of Artificial Sequence:  Enzymatic Nucleic Acid
  misc_feature (18)..(25): n stands for any nucleotide and can be optionally absent
cagaagaacugaugaggnnnnnnnnccgaaaccuuuuc

SEQ ID NO: 4581 - RNA, 38 nt, Artificial Sequence
  Description of Artificial Sequence:  Enzymatic Nucleic Acid
  misc_feature (18)..(25): n stands for any nucleotide and can be optionally absent
uucagaagcugaugaggnnnnnnnnccgaaagaccuuu

SEQ ID NO: 4582 - RNA, 38 nt, Artificial Sequence
  Description of Artificial Sequence:  Enzymatic Nucleic Acid
  misc_feature (18)..(25): n stands for any nucleotide and can be optionally absent
uuucagaacugaugaggnnnnnnnnccgaaaagaccuu

SEQ ID NO: 4583 - RNA, 38 nt, Artificial Sequence
  Description of Artificial Sequence:  Enzymatic Nucleic Acid
  misc_feature (18)..(25): n stands for any nucleotide and can be optionally absent
uauuucagcugaugaggnnnnnnnnccgaaagaagacc

SEQ ID NO: 4584 - RNA, 38 nt, Artificial Sequence
  Description of Artificial Sequence:  Enzymatic Nucleic Acid
  misc_feature (18)..(25): n stands for any nucleotide and can be optionally absent
uuauuucacugaugaggnnnnnnnnccgaaaagaagac

SEQ ID NO: 4585 - RNA, 38 nt, Artificial Sequence
  Description of Artificial Sequence:  Enzymatic Nucleic Acid
  misc_feature (18)..(25): n stands for any nucleotide and can be optionally absent
ucagucuucugaugaggnnnnnnnnccgaaauuucaga

SEQ ID NO: 4586 - RNA, 38 nt, Artificial Sequence
  Description of Artificial Sequence:  Enzymatic Nucleic Acid
  misc_feature (18)..(25): n stands for any nucleotide and can be optionally absent
uugauaggcugaugaggnnnnnnnnccgaaagucaguc

SEQ ID NO: 4587 - RNA, 38 nt, Artificial Sequence
  Description of Artificial Sequence:  Enzymatic Nucleic Acid
  misc_feature (18)..(25): n stands for any nucleotide and can be optionally absent
auaauugacugaugaggnnnnnnnnccgaaagguaguc

SEQ ID NO: 4588 - RNA, 38 nt, Artificial Sequence
  Description of Artificial Sequence:  Enzymatic Nucleic Acid
  misc_feature (18)..(25): n stands for any nucleotide and can be optionally absent
uuauaauucugaugaggnnnnnnnnccgaaauagguag

SEQ ID NO: 4589 - RNA, 38 nt, Artificial Sequence
  Description of Artificial Sequence:  Enzymatic Nucleic Acid
  misc_feature (18)..(25): n stands for any nucleotide and can be optionally absent
uccauuaucugaugaggnnnnnnnnccgaaauugauag

SEQ ID NO: 4590 - RNA, 38 nt, Artificial Sequence
  Description of Artificial Sequence:  Enzymatic Nucleic Acid
  misc_feature (18)..(25): n stands for any nucleotide and can be optionally absent
guccauuacugaugaggnnnnnnnnccgaaaauugaua

SEQ ID NO: 4591 - RNA, 38 nt, Artificial Sequence
  Description of Artificial Sequence:  Enzymatic Nucleic Acid
  misc_feature (18)..(25): n stands for any nucleotide and can be optionally absent
ggguccaucugaugaggnnnnnnnnccgaaauaauuga

SEQ ID NO: 4592 - RNA, 38 nt, Artificial Sequence
  Description of Artificial Sequence:  Enzymatic Nucleic Acid
  misc_feature (18)..(25): n stands for any nucleotide and can be optionally absent
uccaaaggcugaugaggnnnnnnnnccgaaacuucauc

SEQ ID NO: 4593 - RNA, 38 nt, Artificial Sequence
  Description of Artificial Sequence:  Enzymatic Nucleic Acid
  misc_feature (18)..(25): n stands for any nucleotide and can be optionally absent
auccaaagcugaugaggnnnnnnnnccgaaaacuucau

SEQ ID NO: 4594 - RNA, 38 nt, Artificial Sequence
  Description of Artificial Sequence:  Enzymatic Nucleic Acid
  misc_feature (18)..(25): n stands for any nucleotide and can be optionally absent
cucauccacugaugaggnnnnnnnnccgaaaggaacuu

SEQ ID NO: 4595 - RNA, 38 nt, Artificial Sequence
  Description of Artificial Sequence:  Enzymatic Nucleic Acid
  misc_feature (18)..(25): n stands for any nucleotide and can be optionally absent
gcucaucccugaugaggnnnnnnnnccgaaaaggaacu

SEQ ID NO: 4596 - RNA, 38 nt, Artificial Sequence
  Description of Artificial Sequence:  Enzymatic Nucleic Acid
  misc_feature (18)..(25): n stands for any nucleotide and can be optionally absent
ucauaaggcugaugaggnnnnnnnnccgaaagccgcuc

SEQ ID NO: 4597 - RNA, 38 nt, Artificial Sequence
  Description of Artificial Sequence:  Enzymatic Nucleic Acid
  misc_feature (18)..(25): n stands for any nucleotide and can be optionally absent
ggcaucaucugaugaggnnnnnnnnccgaaagggagcc

SEQ ID NO: 4598 - RNA, 38 nt, Artificial Sequence
  Description of Artificial Sequence:  Enzymatic Nucleic Acid
  misc_feature (18)..(25): n stands for any nucleotide and can be optionally absent
uggcaucacugaugaggnnnnnnnnccgaaaagggagc

SEQ ID NO: 4599 - RNA, 38 nt, Artificial Sequence
  Description of Artificial Sequence:  Enzymatic Nucleic Acid
  misc_feature (18)..(25): n stands for any nucleotide and can be optionally absent
cccgggcacugaugaggnnnnnnnnccgaaacucccac

SEQ ID NO: 4600 - RNA, 38 nt, Artificial Sequence
  Description of Artificial Sequence:  Enzymatic Nucleic Acid
  misc_feature (18)..(25): n stands for any nucleotide and can be optionally absent
ucccgggccugaugaggnnnnnnnnccgaaaacuccca

SEQ ID NO: 4601 - RNA, 38 nt, Artificial Sequence
  Description of Artificial Sequence:  Enzymatic Nucleic Acid
  misc_feature (18)..(25): n stands for any nucleotide and can be optionally absent
cccaguuucugaugaggnnnnnnnnccgaaagucucuc

SEQ ID NO: 4602 - RNA, 38 nt, Artificial Sequence
  Description of Artificial Sequence:  Enzymatic Nucleic Acid
  misc_feature (18)..(25): n stands for any nucleotide and can be optionally absent
gcccaguucugaugaggnnnnnnnnccgaaaagucucu

SEQ ID NO: 4603 - RNA, 38 nt, Artificial Sequence
  Description of Artificial Sequence:  Enzymatic Nucleic Acid
  misc_feature (18)..(25): n stands for any nucleotide and can be optionally absent
uuccaagucugaugaggnnnnnnnnccgaaauuugccc

SEQ ID NO: 4604 - RNA, 38 nt, Artificial Sequence
  Description of Artificial Sequence:  Enzymatic Nucleic Acid
  misc_feature (18)..(25): n stands for any nucleotide and can be optionally absent
ccucuucccugaugaggnnnnnnnnccgaaagugauuu

SEQ ID NO: 4605 - RNA, 38 nt, Artificial Sequence
  Description of Artificial Sequence:  Enzymatic Nucleic Acid
  misc_feature (18)..(25): n stands for any nucleotide and can be optionally absent
uuuuccaacugaugaggnnnnnnnnccgaaagccccuc

SEQ ID NO: 4606 - RNA, 38 nt, Artificial Sequence
  Description of Artificial Sequence:  Enzymatic Nucleic Acid
  misc_feature (18)..(25): n stands for any nucleotide and can be optionally absent
cuuuuccacugaugaggnnnnnnnnccgaaaagccccu

SEQ ID NO: 4607 - RNA, 38 nt, Artificial Sequence
  Description of Artificial Sequence:  Enzymatic Nucleic Acid
  misc_feature (18)..(25): n stands for any nucleotide and can be optionally absent
acuuuucccugaugaggnnnnnnnnccgaaaaagcccc

SEQ ID NO: 4608 - RNA, 38 nt, Artificial Sequence
  Description of Artificial Sequence:  Enzymatic Nucleic Acid
  misc_feature (18)..(25): n stands for any nucleotide and can be optionally absent
gaugcuugcugaugaggnnnnnnnnccgaaaccacuuu

SEQ ID NO: 4609 - RNA, 38 nt, Artificial Sequence
  Description of Artificial Sequence:  Enzymatic Nucleic Acid
  misc_feature (18)..(25): n stands for any nucleotide and can be optionally absent
ugaugcuucugaugaggnnnnnnnnccgaaaaccacuu

SEQ ID NO: 4610 - RNA, 38 nt, Artificial Sequence
  Description of Artificial Sequence:  Enzymatic Nucleic Acid
  misc_feature (18)..(25): n stands for any nucleotide and can be optionally absent
caaaugcucugaugaggnnnnnnnnccgaaaugcuuga

SEQ ID NO: 4611 - RNA, 38 nt, Artificial Sequence
  Description of Artificial Sequence:  Enzymatic Nucleic Acid
  misc_feature (18)..(25): n stands for any nucleotide and can be optionally absent
uaaugccacugaugaggnnnnnnnnccgaaaugcugau

SEQ ID NO: 4612 - RNA, 38 nt, Artificial Sequence
  Description of Artificial Sequence:  Enzymatic Nucleic Acid
  misc_feature (18)..(25): n stands for any nucleotide and can be optionally absent
uuaaugcccugaugaggnnnnnnnnccgaaaaugcuga

SEQ ID NO: 4613 - RNA, 38 nt, Artificial Sequence
  Description of Artificial Sequence:  Enzymatic Nucleic Acid
  misc_feature (18)..(25): n stands for any nucleotide and can be optionally absent
gauuucuucugaugaggnnnnnnnnccgaaaugccaaa

SEQ ID NO: 4614 - RNA, 38 nt, Artificial Sequence
  Description of Artificial Sequence:  Enzymatic Nucleic Acid
  misc_feature (18)..(25): n stands for any nucleotide and can be optionally absent
ugauuucucugaugaggnnnnnnnnccgaaaaugccaa

SEQ ID NO: 4615 - RNA, 38 nt, Artificial Sequence
  Description of Artificial Sequence:  Enzymatic Nucleic Acid
  misc_feature (18)..(25): n stands for any nucleotide and can be optionally absent
acguaggucugaugaggnnnnnnnnccgaaauuucuua

SEQ ID NO: 4616 - RNA, 38 nt, Artificial Sequence
  Description of Artificial Sequence:  Enzymatic Nucleic Acid
  misc_feature (18)..(25): n stands for any nucleotide and can be optionally absent
ccggcacgcugaugaggnnnnnnnnccgaaaggugauu

SEQ ID NO: 4617 - RNA, 38 nt, Artificial Sequence
  Description of Artificial Sequence:  Enzymatic Nucleic Acid
  misc_feature (18)..(25): n stands for any nucleotide and can be optionally absent
gagcuuugcugaugaggnnnnnnnnccgaaacucgcug

SEQ ID NO: 4618 - RNA, 38 nt, Artificial Sequence
  Description of Artificial Sequence:  Enzymatic Nucleic Acid
  misc_feature (18)..(25): n stands for any nucleotide and can be optionally absent
agucaucacugaugaggnnnnnnnnccgaaagcuuugu

SEQ ID NO: 4619 - RNA, 38 nt, Artificial Sequence
  Description of Artificial Sequence:  Enzymatic Nucleic Acid
  misc_feature (18)..(25): n stands for any nucleotide and can be optionally absent
aagauuuucugaugaggnnnnnnnnccgaaagcucagu

SEQ ID NO: 4620 - RNA, 38 nt, Artificial Sequence
  Description of Artificial Sequence:  Enzymatic Nucleic Acid
  misc_feature (18)..(25): n stands for any nucleotide and can be optionally absent
ugggucaacugaugaggnnnnnnnnccgaaauuuuuag

SEQ ID NO: 4621 - RNA, 38 nt, Artificial Sequence
  Description of Artificial Sequence:  Enzymatic Nucleic Acid
  misc_feature (18)..(25): n stands for any nucleotide and can be optionally absent
uguggguccugaugaggnnnnnnnnccgaaagauuuuu

SEQ ID NO: 4622 - RNA, 38 nt, Artificial Sequence
  Description of Artificial Sequence:  Enzymatic Nucleic Acid
  misc_feature (18)..(25): n stands for any nucleotide and can be optionally absent
ugguggcccugaugaggnnnnnnnnccgaaaugugggu

SEQ ID NO: 4623 - RNA, 38 nt, Artificial Sequence
  Description of Artificial Sequence:  Enzymatic Nucleic Acid
  misc_feature (18)..(25): n stands for any nucleotide and can be optionally absent
cacguucacugaugaggnnnnnnnnccgaaaugguggc

SEQ ID NO: 4624 - RNA, 38 nt, Artificial Sequence
  Description of Artificial Sequence:  Enzymatic Nucleic Acid
  misc_feature (18)..(25): n stands for any nucleotide and can be optionally absent
agcagguucugaugaggnnnnnnnnccgaaaccacguu

SEQ ID NO: 4625 - RNA, 38 nt, Artificial Sequence
  Description of Artificial Sequence:  Enzymatic Nucleic Acid
  misc_feature (18)..(25): n stands for any nucleotide and can be optionally absent
cagcaggucugaugaggnnnnnnnnccgaaaaccacgu

SEQ ID NO: 4626 - RNA, 38 nt, Artificial Sequence
  Description of Artificial Sequence:  Enzymatic Nucleic Acid
  misc_feature (18)..(25): n stands for any nucleotide and can be optionally absent
caccaucacugaugaggnnnnnnnnccgaaaggcccuc

SEQ ID NO: 4627 - RNA, 38 nt, Artificial Sequence
  Description of Artificial Sequence:  Enzymatic Nucleic Acid
  misc_feature (18)..(25): n stands for any nucleotide and can be optionally absent
uauucaaccugaugaggnnnnnnnnccgaaaucaccau

SEQ ID NO: 4628 - RNA, 38 nt, Artificial Sequence
  Description of Artificial Sequence:  Enzymatic Nucleic Acid
  misc_feature (18)..(25): n stands for any nucleotide and can be optionally absent
caguauuccugaugaggnnnnnnnnccgaaacaaucac

SEQ ID NO: 4629 - RNA, 38 nt, Artificial Sequence
  Description of Artificial Sequence:  Enzymatic Nucleic Acid
  misc_feature (18)..(25): n stands for any nucleotide and can be optionally absent
auuugcagcugaugaggnnnnnnnnccgaaauucaaca

SEQ ID NO: 4630 - RNA, 38 nt, Artificial Sequence
  Description of Artificial Sequence:  Enzymatic Nucleic Acid
  misc_feature (18)..(25): n stands for any nucleotide and can be optionally absent
gauuuccacugaugaggnnnnnnnnccgaaauuugcag

SEQ ID NO: 4631 - RNA, 38 nt, Artificial Sequence
  Description of Artificial Sequence:  Enzymatic Nucleic Acid
  misc_feature (18)..(25): n stands for any nucleotide and can be optionally absent
guuggagacugaugaggnnnnnnnnccgaaauuuccau

SEQ ID NO: 4632 - RNA, 38 nt, Artificial Sequence
  Description of Artificial Sequence:  Enzymatic Nucleic Acid
  misc_feature (18)..(25): n stands for any nucleotide and can be optionally absent
uaguuggacugaugaggnnnnnnnnccgaaagauuucc

SEQ ID NO: 4633 - RNA, 38 nt, Artificial Sequence
  Description of Artificial Sequence:  Enzymatic Nucleic Acid
  misc_feature (18)..(25): n stands for any nucleotide and can be optionally absent
gguaguugcugaugaggnnnnnnnnccgaaagagauuu

SEQ ID NO: 4634 - RNA, 38 nt, Artificial Sequence
  Description of Artificial Sequence:  Enzymatic Nucleic Acid
  misc_feature (18)..(25): n stands for any nucleotide and can be optionally absent
ucuugaggcugaugaggnnnnnnnnccgaaaguuggag

SEQ ID NO: 4635 - RNA, 38 nt, Artificial Sequence
  Description of Artificial Sequence:  Enzymatic Nucleic Acid
  misc_feature (18)..(25): n stands for any nucleotide and can be optionally absent
uugcucuucugaugaggnnnnnnnnccgaaagguaguu

SEQ ID NO: 4636 - RNA, 38 nt, Artificial Sequence
  Description of Artificial Sequence:  Enzymatic Nucleic Acid
  misc_feature (18)..(25): n stands for any nucleotide and can be optionally absent
gaaaaaaucugaugaggnnnnnnnnccgaaagucacgu

SEQ ID NO: 4637 - RNA, 38 nt, Artificial Sequence
  Description of Artificial Sequence:  Enzymatic Nucleic Acid
  misc_feature (18)..(25): n stands for any nucleotide and can be optionally absent
agaaaaaacugaugaggnnnnnnnnccgaaaagucacg

SEQ ID NO: 4638 - RNA, 38 nt, Artificial Sequence
  Description of Artificial Sequence:  Enzymatic Nucleic Acid
  misc_feature (18)..(25): n stands for any nucleotide and can be optionally absent
ugagaaaacugaugaggnnnnnnnnccgaaauaaguca

SEQ ID NO: 4639 - RNA, 38 nt, Artificial Sequence
  Description of Artificial Sequence:  Enzymatic Nucleic Acid
  misc_feature (18)..(25): n stands for any nucleotide and can be optionally absent
uugagaaacugaugaggnnnnnnnnccgaaaauaaguc

SEQ ID NO: 4640 - RNA, 38 nt, Artificial Sequence
  Description of Artificial Sequence:  Enzymatic Nucleic Acid
  misc_feature (18)..(25): n stands for any nucleotide and can be optionally absent
guugagaacugaugaggnnnnnnnnccgaaaaauaagu

SEQ ID NO: 4641 - RNA, 38 nt, Artificial Sequence
  Description of Artificial Sequence:  Enzymatic Nucleic Acid
  misc_feature (18)..(25): n stands for any nucleotide and can be optionally absent
uguugagacugaugaggnnnnnnnnccgaaaaaauaag

SEQ ID NO: 4642 - RNA, 38 nt, Artificial Sequence
  Description of Artificial Sequence:  Enzymatic Nucleic Acid
  misc_feature (18)..(25): n stands for any nucleotide and can be optionally absent
uuguugagcugaugaggnnnnnnnnccgaaaaaaauaa

SEQ ID NO: 4643 - RNA, 38 nt, Artificial Sequence
  Description of Artificial Sequence:  Enzymatic Nucleic Acid
  misc_feature (18)..(25): n stands for any nucleotide and can be optionally absent
cuuguugacugaugaggnnnnnnnnccgaaaaaaaaua

SEQ ID NO: 4644 - RNA, 38 nt, Artificial Sequence
  Description of Artificial Sequence:  Enzymatic Nucleic Acid
  misc_feature (18)..(25): n stands for any nucleotide and can be optionally absent
uccuuguucugaugaggnnnnnnnnccgaaagaaaaaa

SEQ ID NO: 4645 - RNA, 38 nt, Artificial Sequence
  Description of Artificial Sequence:  Enzymatic Nucleic Acid
  misc_feature (18)..(25): n stands for any nucleotide and can be optionally absent
uccaugugcugaugaggnnnnnnnnccgaaagugcugc

SEQ ID NO: 4646 - RNA, 38 nt, Artificial Sequence
  Description of Artificial Sequence:  Enzymatic Nucleic Acid
  misc_feature (18)..(25): n stands for any nucleotide and can be optionally absent
uucuuucucugaugaggnnnnnnnnccgaaaggcucca

SEQ ID NO: 4647 - RNA, 38 nt, Artificial Sequence
  Description of Artificial Sequence:  Enzymatic Nucleic Acid
  misc_feature (18)..(25): n stands for any nucleotide and can be optionally absent
acgcuauccugaugaggnnnnnnnnccgaaagucuugg

SEQ ID NO: 4648 - RNA, 38 nt, Artificial Sequence
  Description of Artificial Sequence:  Enzymatic Nucleic Acid
  misc_feature (18)..(25): n stands for any nucleotide and can be optionally absent
ggugacgccugaugaggnnnnnnnnccgaaaucuaguc

SEQ ID NO: 4649 - RNA, 38 nt, Artificial Sequence
  Description of Artificial Sequence:  Enzymatic Nucleic Acid
  misc_feature (18)..(25): n stands for any nucleotide and can be optionally absent
cugcuggucugaugaggnnnnnnnnccgaaacgcuauc

SEQ ID NO: 4650 - RNA, 38 nt, Artificial Sequence
  Description of Artificial Sequence:  Enzymatic Nucleic Acid
  misc_feature (18)..(25): n stands for any nucleotide and can be optionally absent
agcucgcacugaugaggnnnnnnnnccgaaagcuuucg

SEQ ID NO: 4651 - RNA, 38 nt, Artificial Sequence
  Description of Artificial Sequence:  Enzymatic Nucleic Acid
  misc_feature (18)..(25): n stands for any nucleotide and can be optionally absent
gagcucgccugaugaggnnnnnnnnccgaaaagcuuuc

SEQ ID NO: 4652 - RNA, 38 nt, Artificial Sequence
  Description of Artificial Sequence:  Enzymatic Nucleic Acid
  misc_feature (18)..(25): n stands for any nucleotide and can be optionally absent
gaaagccgcugaugaggnnnnnnnnccgaaagcucgca

SEQ ID NO: 4653 - RNA, 38 nt, Artificial Sequence
  Description of Artificial Sequence:  Enzymatic Nucleic Acid
  misc_feature (18)..(25): n stands for any nucleotide and can be optionally absent
cuuccugacugaugaggnnnnnnnnccgaaagccggag

SEQ ID NO: 4654 - RNA, 38 nt, Artificial Sequence
  Description of Artificial Sequence:  Enzymatic Nucleic Acid
  misc_feature (18)..(25): n stands for any nucleotide and can be optionally absent
ucuuccugcugaugaggnnnnnnnnccgaaaagccgga

SEQ ID NO: 4655 - RNA, 38 nt, Artificial Sequence
  Description of Artificial Sequence:  Enzymatic Nucleic Acid
  misc_feature (18)..(25): n stands for any nucleotide and can be optionally absent
aucuuccucugaugaggnnnnnnnnccgaaaaagccgg

SEQ ID NO: 4656 - RNA, 38 nt, Artificial Sequence
  Description of Artificial Sequence:  Enzymatic Nucleic Acid
  misc_feature (18)..(25): n stands for any nucleotide and can be optionally absent
cagacuuucugaugaggnnnnnnnnccgaaaucuuccu

SEQ ID NO: 4657 - RNA, 38 nt, Artificial Sequence
  Description of Artificial Sequence:  Enzymatic Nucleic Acid
  misc_feature (18)..(25): n stands for any nucleotide and can be optionally absent
aucacucacugaugaggnnnnnnnnccgaaacuuuuau

SEQ ID NO: 4658 - RNA, 38 nt, Artificial Sequence
  Description of Artificial Sequence:  Enzymatic Nucleic Acid
  misc_feature (18)..(25): n stands for any nucleotide and can be optionally absent
ucuuccuccugaugaggnnnnnnnnccgaaacaucacu

SEQ ID NO: 4659 - RNA, 38 nt, Artificial Sequence
  Description of Artificial Sequence:  Enzymatic Nucleic Acid
  misc_feature (18)..(25): n stands for any nucleotide and can be optionally absent
accgucagcugaugaggnnnnnnnnccgaaauccuccu

SEQ ID NO: 4660 - RNA, 38 nt, Artificial Sequence
  Description of Artificial Sequence:  Enzymatic Nucleic Acid
  misc_feature (18)..(25): n stands for any nucleotide and can be optionally absent
aaccgucacugaugaggnnnnnnnnccgaaaauccucc

SEQ ID NO: 4661 - RNA, 38 nt, Artificial Sequence
  Description of Artificial Sequence:  Enzymatic Nucleic Acid
  misc_feature (18)..(25): n stands for any nucleotide and can be optionally absent
cuuguagacugaugaggnnnnnnnnccgaaaccgucag

SEQ ID NO: 4662 - RNA, 38 nt, Artificial Sequence
  Description of Artificial Sequence:  Enzymatic Nucleic Acid
  misc_feature (18)..(25): n stands for any nucleotide and can be optionally absent
ccuuguagcugaugaggnnnnnnnnccgaaaaccguca

SEQ ID NO: 4663 - RNA, 38 nt, Artificial Sequence
  Description of Artificial Sequence:  Enzymatic Nucleic Acid
  misc_feature (18)..(25): n stands for any nucleotide and can be optionally absent
uccuuguacugaugaggnnnnnnnnccgaaaaaccguc

SEQ ID NO: 4664 - RNA, 38 nt, Artificial Sequence
  Description of Artificial Sequence:  Enzymatic Nucleic Acid
  misc_feature (18)..(25): n stands for any nucleotide and can be optionally absent
gcuccuugcugaugaggnnnnnnnnccgaaagaaaccg

SEQ ID NO: 4665 - RNA, 38 nt, Artificial Sequence
  Description of Artificial Sequence:  Enzymatic Nucleic Acid
  misc_feature (18)..(25): n stands for any nucleotide and can be optionally absent
uccauagucugaugaggnnnnnnnnccgaaaugggcuc

SEQ ID NO: 4666 - RNA, 38 nt, Artificial Sequence
  Description of Artificial Sequence:  Enzymatic Nucleic Acid
  misc_feature (18)..(25): n stands for any nucleotide and can be optionally absent
aucuuccacugaugaggnnnnnnnnccgaaagugaugg

SEQ ID NO: 4667 - RNA, 38 nt, Artificial Sequence
  Description of Artificial Sequence:  Enzymatic Nucleic Acid
  misc_feature (18)..(25): n stands for any nucleotide and can be optionally absent
agaaaucacugaugaggnnnnnnnnccgaaaucuucca

SEQ ID NO: 4668 - RNA, 38 nt, Artificial Sequence
  Description of Artificial Sequence:  Enzymatic Nucleic Acid
  misc_feature (18)..(25): n stands for any nucleotide and can be optionally absent
cuguaagacugaugaggnnnnnnnnccgaaaucagauc

SEQ ID NO: 4669 - RNA, 38 nt, Artificial Sequence
  Description of Artificial Sequence:  Enzymatic Nucleic Acid
  misc_feature (18)..(25): n stands for any nucleotide and can be optionally absent
acuguaagcugaugaggnnnnnnnnccgaaaaucagau

SEQ ID NO: 4670 - RNA, 38 nt, Artificial Sequence
  Description of Artificial Sequence:  Enzymatic Nucleic Acid
  misc_feature (18)..(25): n stands for any nucleotide and can be optionally absent
aacuguaacugaugaggnnnnnnnnccgaaaaaucaga

SEQ ID NO: 4671 - RNA, 38 nt, Artificial Sequence
  Description of Artificial Sequence:  Enzymatic Nucleic Acid
  misc_feature (18)..(25): n stands for any nucleotide and can be optionally absent
aaaacugucugaugaggnnnnnnnnccgaaagaaauca

SEQ ID NO: 4672 - RNA, 38 nt, Artificial Sequence
  Description of Artificial Sequence:  Enzymatic Nucleic Acid
  misc_feature (18)..(25): n stands for any nucleotide and can be optionally absent
gaaaacugcugaugaggnnnnnnnnccgaaaagaaauc

SEQ ID NO: 4673 - RNA, 38 nt, Artificial Sequence
  Description of Artificial Sequence:  Enzymatic Nucleic Acid
  misc_feature (18)..(25): n stands for any nucleotide and can be optionally absent
cacuugaacugaugaggnnnnnnnnccgaaacuguaag

SEQ ID NO: 4674 - RNA, 38 nt, Artificial Sequence
  Description of Artificial Sequence:  Enzymatic Nucleic Acid
  misc_feature (18)..(25): n stands for any nucleotide and can be optionally absent
ccacuugacugaugaggnnnnnnnnccgaaaacuguaa

SEQ ID NO: 4675 - RNA, 38 nt, Artificial Sequence
  Description of Artificial Sequence:  Enzymatic Nucleic Acid
  misc_feature (18)..(25): n stands for any nucleotide and can be optionally absent
gccacuugcugaugaggnnnnnnnnccgaaaaacugua

SEQ ID NO: 4676 - RNA, 38 nt, Artificial Sequence
  Description of Artificial Sequence:  Enzymatic Nucleic Acid
  misc_feature (18)..(25): n stands for any nucleotide and can be optionally absent
ggccacuucugaugaggnnnnnnnnccgaaaaaacugu

SEQ ID NO: 4677 - RNA, 38 nt, Artificial Sequence
  Description of Artificial Sequence:  Enzymatic Nucleic Acid
  misc_feature (18)..(25): n stands for any nucleotide and can be optionally absent
aagacaggcugaugaggnnnnnnnnccgaaacuccaug

SEQ ID NO: 4678 - RNA, 38 nt, Artificial Sequence
  Description of Artificial Sequence:  Enzymatic Nucleic Acid
  misc_feature (18)..(25): n stands for any nucleotide and can be optionally absent
gaagacagcugaugaggnnnnnnnnccgaaaacuccau

SEQ ID NO: 4679 - RNA, 38 nt, Artificial Sequence
  Description of Artificial Sequence:  Enzymatic Nucleic Acid
  misc_feature (18)..(25): n stands for any nucleotide and can be optionally absent
uucuggaacugaugaggnnnnnnnnccgaaacaggaac

SEQ ID NO: 4680 - RNA, 38 nt, Artificial Sequence
  Description of Artificial Sequence:  Enzymatic Nucleic Acid
  misc_feature (18)..(25): n stands for any nucleotide and can be optionally absent
cuuucuggcugaugaggnnnnnnnnccgaaagacagga

SEQ ID NO: 4681 - RNA, 38 nt, Artificial Sequence
  Description of Artificial Sequence:  Enzymatic Nucleic Acid
  misc_feature (18)..(25): n stands for any nucleotide and can be optionally absent
acuuucugcugaugaggnnnnnnnnccgaaaagacagg

SEQ ID NO: 4682 - RNA, 38 nt, Artificial Sequence
  Description of Artificial Sequence:  Enzymatic Nucleic Acid
  misc_feature (18)..(25): n stands for any nucleotide and can be optionally absent
ucccgaugcugaugaggnnnnnnnnccgaaaugcacuu

SEQ ID NO: 4683 - RNA, 38 nt, Artificial Sequence
  Description of Artificial Sequence:  Enzymatic Nucleic Acid
  misc_feature (18)..(25): n stands for any nucleotide and can be optionally absent
gucccgaucugaugaggnnnnnnnnccgaaaaugcacu

SEQ ID NO: 4684 - RNA, 38 nt, Artificial Sequence
  Description of Artificial Sequence:  Enzymatic Nucleic Acid
  misc_feature (18)..(25): n stands for any nucleotide and can be optionally absent
cagguccccugaugaggnnnnnnnnccgaaaugaaugc

SEQ ID NO: 4685 - RNA, 38 nt, Artificial Sequence
  Description of Artificial Sequence:  Enzymatic Nucleic Acid
  misc_feature (18)..(25): n stands for any nucleotide and can be optionally absent
gauaaaagcugaugaggnnnnnnnnccgaaauguuucu

SEQ ID NO: 4686 - RNA, 38 nt, Artificial Sequence
  Description of Artificial Sequence:  Enzymatic Nucleic Acid
  misc_feature (18)..(25): n stands for any nucleotide and can be optionally absent
agauaaaacugaugaggnnnnnnnnccgaaaauguuuc

SEQ ID NO: 4687 - RNA, 38 nt, Artificial Sequence
  Description of Artificial Sequence:  Enzymatic Nucleic Acid
  misc_feature (18)..(25): n stands for any nucleotide and can be optionally absent
ucagauaacugaugaggnnnnnnnnccgaaagaauguu

SEQ ID NO: 4688 - RNA, 38 nt, Artificial Sequence
  Description of Artificial Sequence:  Enzymatic Nucleic Acid
  misc_feature (18)..(25): n stands for any nucleotide and can be optionally absent
cucagauacugaugaggnnnnnnnnccgaaaagaaugu

SEQ ID NO: 4689 - RNA, 38 nt, Artificial Sequence
  Description of Artificial Sequence:  Enzymatic Nucleic Acid
  misc_feature (18)..(25): n stands for any nucleotide and can be optionally absent
ucucagaucugaugaggnnnnnnnnccgaaaaagaaug

SEQ ID NO: 4690 - RNA, 38 nt, Artificial Sequence
  Description of Artificial Sequence:  Enzymatic Nucleic Acid
  misc_feature (18)..(25): n stands for any nucleotide and can be optionally absent
uucucagacugaugaggnnnnnnnnccgaaaaaagaau

SEQ ID NO: 4691 - RNA, 38 nt, Artificial Sequence
  Description of Artificial Sequence:  Enzymatic Nucleic Acid
  misc_feature (18)..(25): n stands for any nucleotide and can be optionally absent
uguucucacugaugaggnnnnnnnnccgaaauaaaaga

SEQ ID NO: 4692 - RNA, 38 nt, Artificial Sequence
  Description of Artificial Sequence:  Enzymatic Nucleic Acid
  misc_feature (18)..(25): n stands for any nucleotide and can be optionally absent
aaaucacacugaugaggnnnnnnnnccgaaaucuucac

SEQ ID NO: 4693 - RNA, 38 nt, Artificial Sequence
  Description of Artificial Sequence:  Enzymatic Nucleic Acid
  misc_feature (18)..(25): n stands for any nucleotide and can be optionally absent
aaaaucaccugaugaggnnnnnnnnccgaaaaucuuca

SEQ ID NO: 4694 - RNA, 38 nt, Artificial Sequence
  Description of Artificial Sequence:  Enzymatic Nucleic Acid
  misc_feature (18)..(25): n stands for any nucleotide and can be optionally absent
aaggccaacugaugaggnnnnnnnnccgaaaucacaaa

SEQ ID NO: 4695 - RNA, 38 nt, Artificial Sequence
  Description of Artificial Sequence:  Enzymatic Nucleic Acid
  misc_feature (18)..(25): n stands for any nucleotide and can be optionally absent
caaggccacugaugaggnnnnnnnnccgaaaaucacaa

SEQ ID NO: 4696 - RNA, 38 nt, Artificial Sequence
  Description of Artificial Sequence:  Enzymatic Nucleic Acid
  misc_feature (18)..(25): n stands for any nucleotide and can be optionally absent
gcaaggcccugaugaggnnnnnnnnccgaaaaaucaca

SEQ ID NO: 4697 - RNA, 38 nt, Artificial Sequence
  Description of Artificial Sequence:  Enzymatic Nucleic Acid
  misc_feature (18)..(25): n stands for any nucleotide and can be optionally absent
ucccgggccugaugaggnnnnnnnnccgaaaggccaaa

SEQ ID NO: 4698 - RNA, 38 nt, Artificial Sequence
  Description of Artificial Sequence:  Enzymatic Nucleic Acid
  misc_feature (18)..(25): n stands for any nucleotide and can be optionally absent
cuuauaaacugaugaggnnnnnnnnccgaaaucccggg

SEQ ID NO: 4699 - RNA, 38 nt, Artificial Sequence
  Description of Artificial Sequence:  Enzymatic Nucleic Acid
  misc_feature (18)..(25): n stands for any nucleotide and can be optionally absent
uucuuauacugaugaggnnnnnnnnccgaaauaucccg

SEQ ID NO: 4700 - RNA, 38 nt, Artificial Sequence
  Description of Artificial Sequence:  Enzymatic Nucleic Acid
  misc_feature (18)..(25): n stands for any nucleotide and can be optionally absent
guucuuaucugaugaggnnnnnnnnccgaaaauauccc

SEQ ID NO: 4701 - RNA, 38 nt, Artificial Sequence
  Description of Artificial Sequence:  Enzymatic Nucleic Acid
  misc_feature (18)..(25): n stands for any nucleotide and can be optionally absent
gguucuuacugaugaggnnnnnnnnccgaaaaauaucc

SEQ ID NO: 4702 - RNA, 38 nt, Artificial Sequence
  Description of Artificial Sequence:  Enzymatic Nucleic Acid
  misc_feature (18)..(25): n stands for any nucleotide and can be optionally absent
gggguucucugaugaggnnnnnnnnccgaaauaaauau

SEQ ID NO: 4703 - RNA, 38 nt, Artificial Sequence
  Description of Artificial Sequence:  Enzymatic Nucleic Acid
  misc_feature (18)..(25): n stands for any nucleotide and can be optionally absent
ucucacaucugaugaggnnnnnnnnccgaaaucggggu

SEQ ID NO: 4704 - RNA, 38 nt, Artificial Sequence
  Description of Artificial Sequence:  Enzymatic Nucleic Acid
  misc_feature (18)..(25): n stands for any nucleotide and can be optionally absent
uucucacacugaugaggnnnnnnnnccgaaaaucgggg

SEQ ID NO: 4705 - RNA, 38 nt, Artificial Sequence
  Description of Artificial Sequence:  Enzymatic Nucleic Acid
  misc_feature (18)..(25): n stands for any nucleotide and can be optionally absent
aagucgagcugaugaggnnnnnnnnccgaaaucuccuu

SEQ ID NO: 4706 - RNA, 38 nt, Artificial Sequence
  Description of Artificial Sequence:  Enzymatic Nucleic Acid
  misc_feature (18)..(25): n stands for any nucleotide and can be optionally absent
aggaaguccugaugaggnnnnnnnnccgaaaguaucuc

SEQ ID NO: 4707 - RNA, 38 nt, Artificial Sequence
  Description of Artificial Sequence:  Enzymatic Nucleic Acid
  misc_feature (18)..(25): n stands for any nucleotide and can be optionally absent
uucagaggcugaugaggnnnnnnnnccgaaagucgagu

SEQ ID NO: 4708 - RNA, 38 nt, Artificial Sequence
  Description of Artificial Sequence:  Enzymatic Nucleic Acid
  misc_feature (18)..(25): n stands for any nucleotide and can be optionally absent
uuucagagcugaugaggnnnnnnnnccgaaaagucgag

SEQ ID NO: 4709 - RNA, 38 nt, Artificial Sequence
  Description of Artificial Sequence:  Enzymatic Nucleic Acid
  misc_feature (18)..(25): n stands for any nucleotide and can be optionally absent
ccauuucacugaugaggnnnnnnnnccgaaaggaaguc

SEQ ID NO: 4710 - RNA, 38 nt, Artificial Sequence
  Description of Artificial Sequence:  Enzymatic Nucleic Acid
  misc_feature (18)..(25): n stands for any nucleotide and can be optionally absent
agauucggcugaugaggnnnnnnnnccgaaagccaucc

SEQ ID NO: 4711 - RNA, 38 nt, Artificial Sequence
  Description of Artificial Sequence:  Enzymatic Nucleic Acid
  misc_feature (18)..(25): n stands for any nucleotide and can be optionally absent
caaagauacugaugaggnnnnnnnnccgaaauucggga

SEQ ID NO: 4712 - RNA, 38 nt, Artificial Sequence
  Description of Artificial Sequence:  Enzymatic Nucleic Acid
  misc_feature (18)..(25): n stands for any nucleotide and can be optionally absent
gucaaagacugaugaggnnnnnnnnccgaaagauucgg

SEQ ID NO: 4713 - RNA, 38 nt, Artificial Sequence
  Description of Artificial Sequence:  Enzymatic Nucleic Acid
  misc_feature (18)..(25): n stands for any nucleotide and can be optionally absent
uugucaaacugaugaggnnnnnnnnccgaaauagauuc

SEQ ID NO: 4714 - RNA, 38 nt, Artificial Sequence
  Description of Artificial Sequence:  Enzymatic Nucleic Acid
  misc_feature (18)..(25): n stands for any nucleotide and can be optionally absent
uuuugucacugaugaggnnnnnnnnccgaaagauagau

SEQ ID NO: 4715 - RNA, 38 nt, Artificial Sequence
  Description of Artificial Sequence:  Enzymatic Nucleic Acid
  misc_feature (18)..(25): n stands for any nucleotide and can be optionally absent
auuuuguccugaugaggnnnnnnnnccgaaaagauaga

SEQ ID NO: 4716 - RNA, 38 nt, Artificial Sequence
  Description of Artificial Sequence:  Enzymatic Nucleic Acid
  misc_feature (18)..(25): n stands for any nucleotide and can be optionally absent
gugcuguacugaugaggnnnnnnnnccgaaauuuuguc

SEQ ID NO: 4717 - RNA, 38 nt, Artificial Sequence
  Description of Artificial Sequence:  Enzymatic Nucleic Acid
  misc_feature (18)..(25): n stands for any nucleotide and can be optionally absent
uggugcugcugaugaggnnnnnnnnccgaaagauuuug

SEQ ID NO: 4718 - RNA, 38 nt, Artificial Sequence
  Description of Artificial Sequence:  Enzymatic Nucleic Acid
  misc_feature (18)..(25): n stands for any nucleotide and can be optionally absent
cuccguaacugaugaggnnnnnnnnccgaaaccacacg

SEQ ID NO: 4719 - RNA, 38 nt, Artificial Sequence
  Description of Artificial Sequence:  Enzymatic Nucleic Acid
  misc_feature (18)..(25): n stands for any nucleotide and can be optionally absent
uacuccgucugaugaggnnnnnnnnccgaaagaccaca

SEQ ID NO: 4720 - RNA, 38 nt, Artificial Sequence
  Description of Artificial Sequence:  Enzymatic Nucleic Acid
  misc_feature (18)..(25): n stands for any nucleotide and can be optionally absent
auacuccgcugaugaggnnnnnnnnccgaaaagaccac

SEQ ID NO: 4721 - RNA, 38 nt, Artificial Sequence
  Description of Artificial Sequence:  Enzymatic Nucleic Acid
  misc_feature (18)..(25): n stands for any nucleotide and can be optionally absent
cacagcaacugaugaggnnnnnnnnccgaaacuccgua

SEQ ID NO: 4722 - RNA, 38 nt, Artificial Sequence
  Description of Artificial Sequence:  Enzymatic Nucleic Acid
  misc_feature (18)..(25): n stands for any nucleotide and can be optionally absent
cccacagccugaugaggnnnnnnnnccgaaauacuccg

SEQ ID NO: 4723 - RNA, 38 nt, Artificial Sequence
  Description of Artificial Sequence:  Enzymatic Nucleic Acid
  misc_feature (18)..(25): n stands for any nucleotide and can be optionally absent
aaggagaacugaugaggnnnnnnnnccgaaauuuccca

SEQ ID NO: 4724 - RNA, 38 nt, Artificial Sequence
  Description of Artificial Sequence:  Enzymatic Nucleic Acid
  misc_feature (18)..(25): n stands for any nucleotide and can be optionally absent
cuaaggagcugaugaggnnnnnnnnccgaaagauuucc

SEQ ID NO: 4725 - RNA, 38 nt, Artificial Sequence
  Description of Artificial Sequence:  Enzymatic Nucleic Acid
  misc_feature (18)..(25): n stands for any nucleotide and can be optionally absent
ccuaaggacugaugaggnnnnnnnnccgaaaagauuuc

SEQ ID NO: 4726 - RNA, 38 nt, Artificial Sequence
  Description of Artificial Sequence:  Enzymatic Nucleic Acid
  misc_feature (18)..(25): n stands for any nucleotide and can be optionally absent
caccuaagcugaugaggnnnnnnnnccgaaagaagauu

SEQ ID NO: 4727 - RNA, 38 nt, Artificial Sequence
  Description of Artificial Sequence:  Enzymatic Nucleic Acid
  misc_feature (18)..(25): n stands for any nucleotide and can be optionally absent
acccaccucugaugaggnnnnnnnnccgaaaggagaag

SEQ ID NO: 4728 - RNA, 38 nt, Artificial Sequence
  Description of Artificial Sequence:  Enzymatic Nucleic Acid
  misc_feature (18)..(25): n stands for any nucleotide and can be optionally absent
gacccacccugaugaggnnnnnnnnccgaaaaggagaa

SEQ ID NO: 4729 - RNA, 38 nt, Artificial Sequence
  Description of Artificial Sequence:  Enzymatic Nucleic Acid
  misc_feature (18)..(25): n stands for any nucleotide and can be optionally absent
gguauggacugaugaggnnnnnnnnccgaaacccaccu

SEQ ID NO: 4730 - RNA, 38 nt, Artificial Sequence
  Description of Artificial Sequence:  Enzymatic Nucleic Acid
  misc_feature (18)..(25): n stands for any nucleotide and can be optionally absent
uggguaugcugaugaggnnnnnnnnccgaaagacccac

SEQ ID NO: 4731 - RNA, 38 nt, Artificial Sequence
  Description of Artificial Sequence:  Enzymatic Nucleic Acid
  misc_feature (18)..(25): n stands for any nucleotide and can be optionally absent
cuccugggcugaugaggnnnnnnnnccgaaauggagac

SEQ ID NO: 4732 - RNA, 38 nt, Artificial Sequence
  Description of Artificial Sequence:  Enzymatic Nucleic Acid
  misc_feature (18)..(25): n stands for any nucleotide and can be optionally absent
uccauuugcugaugaggnnnnnnnnccgaaacuccugg

SEQ ID NO: 4733 - RNA, 38 nt, Artificial Sequence
  Description of Artificial Sequence:  Enzymatic Nucleic Acid
  misc_feature (18)..(25): n stands for any nucleotide and can be optionally absent
gacugcaacugaugaggnnnnnnnnccgaaaguccuca

SEQ ID NO: 4734 - RNA, 38 nt, Artificial Sequence
  Description of Artificial Sequence:  Enzymatic Nucleic Acid
  misc_feature (18)..(25): n stands for any nucleotide and can be optionally absent
cgacugcacugaugaggnnnnnnnnccgaaaaguccuc

SEQ ID NO: 4735 - RNA, 38 nt, Artificial Sequence
  Description of Artificial Sequence:  Enzymatic Nucleic Acid
  misc_feature (18)..(25): n stands for any nucleotide and can be optionally absent
gcgacugccugaugaggnnnnnnnnccgaaaaaguccu

SEQ ID NO: 4736 - RNA, 38 nt, Artificial Sequence
  Description of Artificial Sequence:  Enzymatic Nucleic Acid
  misc_feature (18)..(25): n stands for any nucleotide and can be optionally absent
ccucaggccugaugaggnnnnnnnnccgaaacugcaaa

SEQ ID NO: 4737 - RNA, 38 nt, Artificial Sequence
  Description of Artificial Sequence:  Enzymatic Nucleic Acid
  misc_feature (18)..(25): n stands for any nucleotide and can be optionally absent
guacucagcugaugaggnnnnnnnnccgaaagcucuca

SEQ ID NO: 4738 - RNA, 38 nt, Artificial Sequence
  Description of Artificial Sequence:  Enzymatic Nucleic Acid
  misc_feature (18)..(25): n stands for any nucleotide and can be optionally absent
gaguagagcugaugaggnnnnnnnnccgaaacucagga

SEQ ID NO: 4739 - RNA, 38 nt, Artificial Sequence
  Description of Artificial Sequence:  Enzymatic Nucleic Acid
  misc_feature (18)..(25): n stands for any nucleotide and can be optionally absent
caggaguacugaugaggnnnnnnnnccgaaaguacuca

SEQ ID NO: 4740 - RNA, 38 nt, Artificial Sequence
  Description of Artificial Sequence:  Enzymatic Nucleic Acid
  misc_feature (18)..(25): n stands for any nucleotide and can be optionally absent
uucaggagcugaugaggnnnnnnnnccgaaagaguacu

SEQ ID NO: 4741 - RNA, 38 nt, Artificial Sequence
  Description of Artificial Sequence:  Enzymatic Nucleic Acid
  misc_feature (18)..(25): n stands for any nucleotide and can be optionally absent
gauuucagcugaugaggnnnnnnnnccgaaaguagagu

SEQ ID NO: 4742 - RNA, 38 nt, Artificial Sequence
  Description of Artificial Sequence:  Enzymatic Nucleic Acid
  misc_feature (18)..(25): n stands for any nucleotide and can be optionally absent
aucugauacugaugaggnnnnnnnnccgaaauuucagg

SEQ ID NO: 4743 - RNA, 38 nt, Artificial Sequence
  Description of Artificial Sequence:  Enzymatic Nucleic Acid
  misc_feature (18)..(25): n stands for any nucleotide and can be optionally absent
ugaucugacugaugaggnnnnnnnnccgaaagauuuca

SEQ ID NO: 4744 - RNA, 38 nt, Artificial Sequence
  Description of Artificial Sequence:  Enzymatic Nucleic Acid
  misc_feature (18)..(25): n stands for any nucleotide and can be optionally absent
caugaucucugaugaggnnnnnnnnccgaaauagauuu

SEQ ID NO: 4745 - RNA, 38 nt, Artificial Sequence
  Description of Artificial Sequence:  Enzymatic Nucleic Acid
  misc_feature (18)..(25): n stands for any nucleotide and can be optionally absent
uccagcaucugaugaggnnnnnnnnccgaaaucugaua

SEQ ID NO: 4746 - RNA, 38 nt, Artificial Sequence
  Description of Artificial Sequence:  Enzymatic Nucleic Acid
  misc_feature (18)..(25): n stands for any nucleotide and can be optionally absent
guucugcacugaugaggnnnnnnnnccgaaaucuuggc

SEQ ID NO: 4747 - RNA, 38 nt, Artificial Sequence
  Description of Artificial Sequence:  Enzymatic Nucleic Acid
  misc_feature (18)..(25): n stands for any nucleotide and can be optionally absent
aguucugccugaugaggnnnnnnnnccgaaaaucuugg

SEQ ID NO: 4748 - RNA, 38 nt, Artificial Sequence
  Description of Artificial Sequence:  Enzymatic Nucleic Acid
  misc_feature (18)..(25): n stands for any nucleotide and can be optionally absent
uuuuccaccugaugaggnnnnnnnnccgaaaguucugc

SEQ ID NO: 4749 - RNA, 38 nt, Artificial Sequence
  Description of Artificial Sequence:  Enzymatic Nucleic Acid
  misc_feature (18)..(25): n stands for any nucleotide and can be optionally absent
aaaucacccugaugaggnnnnnnnnccgaaaguuuuuc

SEQ ID NO: 4750 - RNA, 38 nt, Artificial Sequence
  Description of Artificial Sequence:  Enzymatic Nucleic Acid
  misc_feature (18)..(25): n stands for any nucleotide and can be optionally absent
uugaagcacugaugaggnnnnnnnnccgaaaucaccua

SEQ ID NO: 4751 - RNA, 38 nt, Artificial Sequence
  Description of Artificial Sequence:  Enzymatic Nucleic Acid
  misc_feature (18)..(25): n stands for any nucleotide and can be optionally absent
cuugaagccugaugaggnnnnnnnnccgaaaaucaccu

SEQ ID NO: 4752 - RNA, 38 nt, Artificial Sequence
  Description of Artificial Sequence:  Enzymatic Nucleic Acid
  misc_feature (18)..(25): n stands for any nucleotide and can be optionally absent
uuugcuugcugaugaggnnnnnnnnccgaaagcaaauc

SEQ ID NO: 4753 - RNA, 38 nt, Artificial Sequence
  Description of Artificial Sequence:  Enzymatic Nucleic Acid
  misc_feature (18)..(25): n stands for any nucleotide and can be optionally absent
auuugcuucugaugaggnnnnnnnnccgaaaagcaaau

SEQ ID NO: 4754 - RNA, 38 nt, Artificial Sequence
  Description of Artificial Sequence:  Enzymatic Nucleic Acid
  misc_feature (18)..(25): n stands for any nucleotide and can be optionally absent
uccuguugcugaugaggnnnnnnnnccgaaacauuugc

SEQ ID NO: 4755 - RNA, 38 nt, Artificial Sequence
  Description of Artificial Sequence:  Enzymatic Nucleic Acid
  misc_feature (18)..(25): n stands for any nucleotide and can be optionally absent
guagucuucugaugaggnnnnnnnnccgaaaccauccu

SEQ ID NO: 4756 - RNA, 38 nt, Artificial Sequence
  Description of Artificial Sequence:  Enzymatic Nucleic Acid
  misc_feature (18)..(25): n stands for any nucleotide and can be optionally absent
uugggaugcugaugaggnnnnnnnnccgaaagucuuua

SEQ ID NO: 4757 - RNA, 38 nt, Artificial Sequence
  Description of Artificial Sequence:  Enzymatic Nucleic Acid
  misc_feature (18)..(25): n stands for any nucleotide and can be optionally absent
uugauuggcugaugaggnnnnnnnnccgaaauguaguc

SEQ ID NO: 4758 - RNA, 38 nt, Artificial Sequence
  Description of Artificial Sequence:  Enzymatic Nucleic Acid
  misc_feature (18)..(25): n stands for any nucleotide and can be optionally absent
auggcauucugaugaggnnnnnnnnccgaaauugggau

SEQ ID NO: 4759 - RNA, 38 nt, Artificial Sequence
  Description of Artificial Sequence:  Enzymatic Nucleic Acid
  misc_feature (18)..(25): n stands for any nucleotide and can be optionally absent
ccugucagcugaugaggnnnnnnnnccgaaauggcauu

SEQ ID NO: 4760 - RNA, 38 nt, Artificial Sequence
  Description of Artificial Sequence:  Enzymatic Nucleic Acid
  misc_feature (18)..(25): n stands for any nucleotide and can be optionally absent
aaacccaccugaugaggnnnnnnnnccgaaauuuccug

SEQ ID NO: 4761 - RNA, 38 nt, Artificial Sequence
  Description of Artificial Sequence:  Enzymatic Nucleic Acid
  misc_feature (18)..(25): n stands for any nucleotide and can be optionally absent
aguauguacugaugaggnnnnnnnnccgaaacccacua

SEQ ID NO: 4762 - RNA, 38 nt, Artificial Sequence
  Description of Artificial Sequence:  Enzymatic Nucleic Acid
  misc_feature (18)..(25): n stands for any nucleotide and can be optionally absent
gaguaugucugaugaggnnnnnnnnccgaaaacccacu

SEQ ID NO: 4763 - RNA, 38 nt, Artificial Sequence
  Description of Artificial Sequence:  Enzymatic Nucleic Acid
  misc_feature (18)..(25): n stands for any nucleotide and can be optionally absent
ugaguaugcugaugaggnnnnnnnnccgaaaaacccac

SEQ ID NO: 4764 - RNA, 38 nt, Artificial Sequence
  Description of Artificial Sequence:  Enzymatic Nucleic Acid
  misc_feature (18)..(25): n stands for any nucleotide and can be optionally absent
gaguugagcugaugaggnnnnnnnnccgaaauguaaac

SEQ ID NO: 4765 - RNA, 38 nt, Artificial Sequence
  Description of Artificial Sequence:  Enzymatic Nucleic Acid
  misc_feature (18)..(25): n stands for any nucleotide and can be optionally absent
caggaguucugaugaggnnnnnnnnccgaaaguaugua

SEQ ID NO: 4766 - RNA, 38 nt, Artificial Sequence
  Description of Artificial Sequence:  Enzymatic Nucleic Acid
  misc_feature (18)..(25): n stands for any nucleotide and can be optionally absent
gaaggcagcugaugaggnnnnnnnnccgaaaguugagu

SEQ ID NO: 4767 - RNA, 38 nt, Artificial Sequence
  Description of Artificial Sequence:  Enzymatic Nucleic Acid
  misc_feature (18)..(25): n stands for any nucleotide and can be optionally absent
ccucagagcugaugaggnnnnnnnnccgaaaggcagga

SEQ ID NO: 4768 - RNA, 38 nt, Artificial Sequence
  Description of Artificial Sequence:  Enzymatic Nucleic Acid
  misc_feature (18)..(25): n stands for any nucleotide and can be optionally absent
uccucagacugaugaggnnnnnnnnccgaaaaggcagg

SEQ ID NO: 4769 - RNA, 38 nt, Artificial Sequence
  Description of Artificial Sequence:  Enzymatic Nucleic Acid
  misc_feature (18)..(25): n stands for any nucleotide and can be optionally absent
aguccucacugaugaggnnnnnnnnccgaaagaaggca

SEQ ID NO: 4770 - RNA, 38 nt, Artificial Sequence
  Description of Artificial Sequence:  Enzymatic Nucleic Acid
  misc_feature (18)..(25): n stands for any nucleotide and can be optionally absent
ccuugaagcugaugaggnnnnnnnnccgaaaguccuca

SEQ ID NO: 4771 - RNA, 38 nt, Artificial Sequence
  Description of Artificial Sequence:  Enzymatic Nucleic Acid
  misc_feature (18)..(25): n stands for any nucleotide and can be optionally absent
uccuugaacugaugaggnnnnnnnnccgaaaaguccuc

SEQ ID NO: 4772 - RNA, 38 nt, Artificial Sequence
  Description of Artificial Sequence:  Enzymatic Nucleic Acid
  misc_feature (18)..(25): n stands for any nucleotide and can be optionally absent
uuuccuugcugaugaggnnnnnnnnccgaaagaagucc

SEQ ID NO: 4773 - RNA, 38 nt, Artificial Sequence
  Description of Artificial Sequence:  Enzymatic Nucleic Acid
  misc_feature (18)..(25): n stands for any nucleotide and can be optionally absent
cuuuccuucugaugaggnnnnnnnnccgaaaagaaguc

SEQ ID NO: 4774 - RNA, 38 nt, Artificial Sequence
  Description of Artificial Sequence:  Enzymatic Nucleic Acid
  misc_feature (18)..(25): n stands for any nucleotide and can be optionally absent
agcugaaacugaugaggnnnnnnnnccgaaacuuuccu

SEQ ID NO: 4775 - RNA, 38 nt, Artificial Sequence
  Description of Artificial Sequence:  Enzymatic Nucleic Acid
  misc_feature (18)..(25): n stands for any nucleotide and can be optionally absent
ggagcugacugaugaggnnnnnnnnccgaaauacuuuc

SEQ ID NO: 4776 - RNA, 38 nt, Artificial Sequence
  Description of Artificial Sequence:  Enzymatic Nucleic Acid
  misc_feature (18)..(25): n stands for any nucleotide and can be optionally absent
cggagcugcugaugaggnnnnnnnnccgaaaauacuuu

SEQ ID NO: 4777 - RNA, 38 nt, Artificial Sequence
  Description of Artificial Sequence:  Enzymatic Nucleic Acid
  misc_feature (18)..(25): n stands for any nucleotide and can be optionally absent
ucggagcucugaugaggnnnnnnnnccgaaaaauacuu

SEQ ID NO: 4778 - RNA, 38 nt, Artificial Sequence
  Description of Artificial Sequence:  Enzymatic Nucleic Acid
  misc_feature (18)..(25): n stands for any nucleotide and can be optionally absent
aaacuucgcugaugaggnnnnnnnnccgaaagcugaaa

SEQ ID NO: 4779 - RNA, 38 nt, Artificial Sequence
  Description of Artificial Sequence:  Enzymatic Nucleic Acid
  misc_feature (18)..(25): n stands for any nucleotide and can be optionally absent
cugaauuacugaugaggnnnnnnnnccgaaacuucgga

SEQ ID NO: 4780 - RNA, 38 nt, Artificial Sequence
  Description of Artificial Sequence:  Enzymatic Nucleic Acid
  misc_feature (18)..(25): n stands for any nucleotide and can be optionally absent
ccugaauucugaugaggnnnnnnnnccgaaaacuucgg

SEQ ID NO: 4781 - RNA, 38 nt, Artificial Sequence
  Description of Artificial Sequence:  Enzymatic Nucleic Acid
  misc_feature (18)..(25): n stands for any nucleotide and can be optionally absent
uccugaaucugaugaggnnnnnnnnccgaaaaacuucg

SEQ ID NO: 4782 - RNA, 38 nt, Artificial Sequence
  Description of Artificial Sequence:  Enzymatic Nucleic Acid
  misc_feature (18)..(25): n stands for any nucleotide and can be optionally absent
gcuuccugcugaugaggnnnnnnnnccgaaauuaaacu

SEQ ID NO: 4783 - RNA, 38 nt, Artificial Sequence
  Description of Artificial Sequence:  Enzymatic Nucleic Acid
  misc_feature (18)..(25): n stands for any nucleotide and can be optionally absent
agcuuccucugaugaggnnnnnnnnccgaaaauuaaac

SEQ ID NO: 4784 - RNA, 38 nt, Artificial Sequence
  Description of Artificial Sequence:  Enzymatic Nucleic Acid
  misc_feature (18)..(25): n stands for any nucleotide and can be optionally absent
caucaucacugaugaggnnnnnnnnccgaaagcuuccu

SEQ ID NO: 4785 - RNA, 38 nt, Artificial Sequence
  Description of Artificial Sequence:  Enzymatic Nucleic Acid
  misc_feature (18)..(25): n stands for any nucleotide and can be optionally absent
acauaucucugaugaggnnnnnnnnccgaaacaucauc

SEQ ID NO: 4786 - RNA, 38 nt, Artificial Sequence
  Description of Artificial Sequence:  Enzymatic Nucleic Acid
  misc_feature (18)..(25): n stands for any nucleotide and can be optionally absent
cauuuacacugaugaggnnnnnnnnccgaaaucugaca

SEQ ID NO: 4787 - RNA, 38 nt, Artificial Sequence
  Description of Artificial Sequence:  Enzymatic Nucleic Acid
  misc_feature (18)..(25): n stands for any nucleotide and can be optionally absent
aaagcauucugaugaggnnnnnnnnccgaaacauaucu

SEQ ID NO: 4788 - RNA, 38 nt, Artificial Sequence
  Description of Artificial Sequence:  Enzymatic Nucleic Acid
  misc_feature (18)..(25): n stands for any nucleotide and can be optionally absent
gaacuugacugaugaggnnnnnnnnccgaaagcauuua

SEQ ID NO: 4789 - RNA, 38 nt, Artificial Sequence
  Description of Artificial Sequence:  Enzymatic Nucleic Acid
  misc_feature (18)..(25): n stands for any nucleotide and can be optionally absent
ugaacuugcugaugaggnnnnnnnnccgaaaagcauuu

SEQ ID NO: 4790 - RNA, 38 nt, Artificial Sequence
  Description of Artificial Sequence:  Enzymatic Nucleic Acid
  misc_feature (18)..(25): n stands for any nucleotide and can be optionally absent
augaacuucugaugaggnnnnnnnnccgaaaaagcauu

SEQ ID NO: 4791 - RNA, 38 nt, Artificial Sequence
  Description of Artificial Sequence:  Enzymatic Nucleic Acid
  misc_feature (18)..(25): n stands for any nucleotide and can be optionally absent
ggcucaugcugaugaggnnnnnnnnccgaaacuugaaa

SEQ ID NO: 4792 - RNA, 38 nt, Artificial Sequence
  Description of Artificial Sequence:  Enzymatic Nucleic Acid
  misc_feature (18)..(25): n stands for any nucleotide and can be optionally absent
aggcucaucugaugaggnnnnnnnnccgaaaacuugaa

SEQ ID NO: 4793 - RNA, 38 nt, Artificial Sequence
  Description of Artificial Sequence:  Enzymatic Nucleic Acid
  misc_feature (18)..(25): n stands for any nucleotide and can be optionally absent
aagguuuucugaugaggnnnnnnnnccgaaauucuuuc

SEQ ID NO: 4794 - RNA, 38 nt, Artificial Sequence
  Description of Artificial Sequence:  Enzymatic Nucleic Acid
  misc_feature (18)..(25): n stands for any nucleotide and can be optionally absent
guucuucacugaugaggnnnnnnnnccgaaagguuuug

SEQ ID NO: 4795 - RNA, 38 nt, Artificial Sequence
  Description of Artificial Sequence:  Enzymatic Nucleic Acid
  misc_feature (18)..(25): n stands for any nucleotide and can be optionally absent
aguucuuccugaugaggnnnnnnnnccgaaaagguuuu

SEQ ID NO: 4796 - RNA, 38 nt, Artificial Sequence
  Description of Artificial Sequence:  Enzymatic Nucleic Acid
  misc_feature (18)..(25): n stands for any nucleotide and can be optionally absent
uucgguaacugaugaggnnnnnnnnccgaaaguucuuc

SEQ ID NO: 4797 - RNA, 38 nt, Artificial Sequence
  Description of Artificial Sequence:  Enzymatic Nucleic Acid
  misc_feature (18)..(25): n stands for any nucleotide and can be optionally absent
auucgguacugaugaggnnnnnnnnccgaaaaguucuu

SEQ ID NO: 4798 - RNA, 38 nt, Artificial Sequence
  Description of Artificial Sequence:  Enzymatic Nucleic Acid
  misc_feature (18)..(25): n stands for any nucleotide and can be optionally absent
cauucggucugaugaggnnnnnnnnccgaaaaaguucu

SEQ ID NO: 4799 - RNA, 38 nt, Artificial Sequence
  Description of Artificial Sequence:  Enzymatic Nucleic Acid
  misc_feature (18)..(25): n stands for any nucleotide and can be optionally absent
gcauucggcugaugaggnnnnnnnnccgaaaaaaguuc

SEQ ID NO: 4800 - RNA, 38 nt, Artificial Sequence
  Description of Artificial Sequence:  Enzymatic Nucleic Acid
  misc_feature (18)..(25): n stands for any nucleotide and can be optionally absent
caaacaugcugaugaggnnnnnnnnccgaaagguggca

SEQ ID NO: 4801 - RNA, 38 nt, Artificial Sequence
  Description of Artificial Sequence:  Enzymatic Nucleic Acid
  misc_feature (18)..(25): n stands for any nucleotide and can be optionally absent
agucaucacugaugaggnnnnnnnnccgaaacauggag

SEQ ID NO: 4802 - RNA, 38 nt, Artificial Sequence
  Description of Artificial Sequence:  Enzymatic Nucleic Acid
  misc_feature (18)..(25): n stands for any nucleotide and can be optionally absent
uagucauccugaugaggnnnnnnnnccgaaaacaugga

SEQ ID NO: 4803 - RNA, 38 nt, Artificial Sequence
  Description of Artificial Sequence:  Enzymatic Nucleic Acid
  misc_feature (18)..(25): n stands for any nucleotide and can be optionally absent
cgcccuggcugaugaggnnnnnnnnccgaaagucauca

SEQ ID NO: 4804 - RNA, 38 nt, Artificial Sequence
  Description of Artificial Sequence:  Enzymatic Nucleic Acid
  misc_feature (18)..(25): n stands for any nucleotide and can be optionally absent
ggccaacacugaugaggnnnnnnnnccgaaagugcugc

SEQ ID NO: 4805 - RNA, 38 nt, Artificial Sequence
  Description of Artificial Sequence:  Enzymatic Nucleic Acid
  misc_feature (18)..(25): n stands for any nucleotide and can be optionally absent
gagaggcccugaugaggnnnnnnnnccgaaacagagug

SEQ ID NO: 4806 - RNA, 38 nt, Artificial Sequence
  Description of Artificial Sequence:  Enzymatic Nucleic Acid
  misc_feature (18)..(25): n stands for any nucleotide and can be optionally absent
gcaugggacugaugaggnnnnnnnnccgaaaggccaac

SEQ ID NO: 4807 - RNA, 38 nt, Artificial Sequence
  Description of Artificial Sequence:  Enzymatic Nucleic Acid
  misc_feature (18)..(25): n stands for any nucleotide and can be optionally absent
cagcauggcugaugaggnnnnnnnnccgaaagaggcca

SEQ ID NO: 4808 - RNA, 38 nt, Artificial Sequence
  Description of Artificial Sequence:  Enzymatic Nucleic Acid
  misc_feature (18)..(25): n stands for any nucleotide and can be optionally absent
uccaggugcugaugaggnnnnnnnnccgaaagcgcuuc

SEQ ID NO: 4809 - RNA, 38 nt, Artificial Sequence
  Description of Artificial Sequence:  Enzymatic Nucleic Acid
  misc_feature (18)..(25): n stands for any nucleotide and can be optionally absent
guccaggucugaugaggnnnnnnnnccgaaaagcgcuu

SEQ ID NO: 4810 - RNA, 38 nt, Artificial Sequence
  Description of Artificial Sequence:  Enzymatic Nucleic Acid
  misc_feature (18)..(25): n stands for any nucleotide and can be optionally absent
ucuugagccugaugaggnnnnnnnnccgaaaggccuug

SEQ ID NO: 4811 - RNA, 38 nt, Artificial Sequence
  Description of Artificial Sequence:  Enzymatic Nucleic Acid
  misc_feature (18)..(25): n stands for any nucleotide and can be optionally absent
ucaaucuucugaugaggnnnnnnnnccgaaagcgaggc

SEQ ID NO: 4812 - RNA, 38 nt, Artificial Sequence
  Description of Artificial Sequence:  Enzymatic Nucleic Acid
  misc_feature (18)..(25): n stands for any nucleotide and can be optionally absent
cucaaguccugaugaggnnnnnnnnccgaaaucuugag

SEQ ID NO: 4813 - RNA, 38 nt, Artificial Sequence
  Description of Artificial Sequence:  Enzymatic Nucleic Acid
  misc_feature (18)..(25): n stands for any nucleotide and can be optionally absent
uuacucuccugaugaggnnnnnnnnccgaaagucaauc

SEQ ID NO: 4814 - RNA, 38 nt, Artificial Sequence
  Description of Artificial Sequence:  Enzymatic Nucleic Acid
  misc_feature (18)..(25): n stands for any nucleotide and can be optionally absent
uuacuggucugaugaggnnnnnnnnccgaaacucucaa

SEQ ID NO: 4815 - RNA, 38 nt, Artificial Sequence
  Description of Artificial Sequence:  Enzymatic Nucleic Acid
  misc_feature (18)..(25): n stands for any nucleotide and can be optionally absent
cuuacuuucugaugaggnnnnnnnnccgaaacugguua

SEQ ID NO: 4816 - RNA, 38 nt, Artificial Sequence
  Description of Artificial Sequence:  Enzymatic Nucleic Acid
  misc_feature (18)..(25): n stands for any nucleotide and can be optionally absent
cgacuccucugaugaggnnnnnnnnccgaaacuuuuac

SEQ ID NO: 4817 - RNA, 38 nt, Artificial Sequence
  Description of Artificial Sequence:  Enzymatic Nucleic Acid
  misc_feature (18)..(25): n stands for any nucleotide and can be optionally absent
acagcccccugaugaggnnnnnnnnccgaaacuccuua

SEQ ID NO: 4818 - RNA, 38 nt, Artificial Sequence
  Description of Artificial Sequence:  Enzymatic Nucleic Acid
  misc_feature (18)..(25): n stands for any nucleotide and can be optionally absent
ugacaucacugaugaggnnnnnnnnccgaaacagcccc

SEQ ID NO: 4819 - RNA, 38 nt, Artificial Sequence
  Description of Artificial Sequence:  Enzymatic Nucleic Acid
  misc_feature (18)..(25): n stands for any nucleotide and can be optionally absent
ggccugcucugaugaggnnnnnnnnccgaaacaucaga

SEQ ID NO: 4820 - RNA, 38 nt, Artificial Sequence
  Description of Artificial Sequence:  Enzymatic Nucleic Acid
  misc_feature (18)..(25): n stands for any nucleotide and can be optionally absent
auggcagacugaugaggnnnnnnnnccgaaacugggcc

SEQ ID NO: 4821 - RNA, 38 nt, Artificial Sequence
  Description of Artificial Sequence:  Enzymatic Nucleic Acid
  misc_feature (18)..(25): n stands for any nucleotide and can be optionally absent
aauggcagcugaugaggnnnnnnnnccgaaaacugggc

SEQ ID NO: 4822 - RNA, 38 nt, Artificial Sequence
  Description of Artificial Sequence:  Enzymatic Nucleic Acid
  misc_feature (18)..(25): n stands for any nucleotide and can be optionally absent
gaauggcacugaugaggnnnnnnnnccgaaaaacuggg

SEQ ID NO: 4823 - RNA, 38 nt, Artificial Sequence
  Description of Artificial Sequence:  Enzymatic Nucleic Acid
  misc_feature (18)..(25): n stands for any nucleotide and can be optionally absent
acagcuggcugaugaggnnnnnnnnccgaaauggcaga

SEQ ID NO: 4824 - RNA, 38 nt, Artificial Sequence
  Description of Artificial Sequence:  Enzymatic Nucleic Acid
  misc_feature (18)..(25): n stands for any nucleotide and can be optionally absent
cacagcugcugaugaggnnnnnnnnccgaaaauggcag

SEQ ID NO: 4825 - RNA, 38 nt, Artificial Sequence
  Description of Artificial Sequence:  Enzymatic Nucleic Acid
  misc_feature (18)..(25): n stands for any nucleotide and can be optionally absent
ccuucgcucugaugaggnnnnnnnnccgaaacgugccc

SEQ ID NO: 4826 - RNA, 38 nt, Artificial Sequence
  Description of Artificial Sequence:  Enzymatic Nucleic Acid
  misc_feature (18)..(25): n stands for any nucleotide and can be optionally absent
cguaggugcugaugaggnnnnnnnnccgaaaccugcgc

SEQ ID NO: 4827 - RNA, 38 nt, Artificial Sequence
  Description of Artificial Sequence:  Enzymatic Nucleic Acid
  misc_feature (18)..(25): n stands for any nucleotide and can be optionally absent
ucguaggucugaugaggnnnnnnnnccgaaaaccugcg

SEQ ID NO: 4828 - RNA, 38 nt, Artificial Sequence
  Description of Artificial Sequence:  Enzymatic Nucleic Acid
  misc_feature (18)..(25): n stands for any nucleotide and can be optionally absent
cguggucgcugaugaggnnnnnnnnccgaaaggugaac

SEQ ID NO: 4829 - RNA, 38 nt, Artificial Sequence
  Description of Artificial Sequence:  Enzymatic Nucleic Acid
  misc_feature (18)..(25): n stands for any nucleotide and can be optionally absent
cagcacgccugaugaggnnnnnnnnccgaaauuuuccu

SEQ ID NO: 4830 - RNA, 38 nt, Artificial Sequence
  Description of Artificial Sequence:  Enzymatic Nucleic Acid
  misc_feature (18)..(25): n stands for any nucleotide and can be optionally absent
ggggcgggcugaugaggnnnnnnnnccgaaagcagcac

SEQ ID NO: 4831 - RNA, 38 nt, Artificial Sequence
  Description of Artificial Sequence:  Enzymatic Nucleic Acid
  misc_feature (18)..(25): n stands for any nucleotide and can be optionally absent
ccgaguugcugaugaggnnnnnnnnccgaaagucuggg

SEQ ID NO: 4832 - RNA, 38 nt, Artificial Sequence
  Description of Artificial Sequence:  Enzymatic Nucleic Acid
  misc_feature (18)..(25): n stands for any nucleotide and can be optionally absent
ggaccacccugaugaggnnnnnnnnccgaaaguuguag

SEQ ID NO: 4833 - RNA, 38 nt, Artificial Sequence
  Description of Artificial Sequence:  Enzymatic Nucleic Acid
  misc_feature (18)..(25): n stands for any nucleotide and can be optionally absent
gaguacagcugaugaggnnnnnnnnccgaaaccaccga

SEQ ID NO: 4834 - RNA, 38 nt, Artificial Sequence
  Description of Artificial Sequence:  Enzymatic Nucleic Acid
  misc_feature (18)..(25): n stands for any nucleotide and can be optionally absent
ggguggagcugaugaggnnnnnnnnccgaaacaggacc

SEQ ID NO: 4835 - RNA, 38 nt, Artificial Sequence
  Description of Artificial Sequence:  Enzymatic Nucleic Acid
  misc_feature (18)..(25): n stands for any nucleotide and can be optionally absent
guggggugcugaugaggnnnnnnnnccgaaaguacagg

SEQ ID NO: 4836 - RNA, 38 nt, Artificial Sequence
  Description of Artificial Sequence:  Enzymatic Nucleic Acid
  misc_feature (18)..(25): n stands for any nucleotide and can be optionally absent
aaacucuacugaugaggnnnnnnnnccgaaaugggugg

SEQ ID NO: 4837 - RNA, 38 nt, Artificial Sequence
  Description of Artificial Sequence:  Enzymatic Nucleic Acid
  misc_feature (18)..(25): n stands for any nucleotide and can be optionally absent
ucaaacuccugaugaggnnnnnnnnccgaaagaugggu

SEQ ID NO: 4838 - RNA, 38 nt, Artificial Sequence
  Description of Artificial Sequence:  Enzymatic Nucleic Acid
  misc_feature (18)..(25): n stands for any nucleotide and can be optionally absent
ucgugucacugaugaggnnnnnnnnccgaaacucuaga

SEQ ID NO: 4839 - RNA, 38 nt, Artificial Sequence
  Description of Artificial Sequence:  Enzymatic Nucleic Acid
  misc_feature (18)..(25): n stands for any nucleotide and can be optionally absent
uucguguccugaugaggnnnnnnnnccgaaaacucuag

SEQ ID NO: 4840 - RNA, 38 nt, Artificial Sequence
  Description of Artificial Sequence:  Enzymatic Nucleic Acid
  misc_feature (18)..(25): n stands for any nucleotide and can be optionally absent
cuagaaaucugaugaggnnnnnnnnccgaaaggcuucg

SEQ ID NO: 4841 - RNA, 38 nt, Artificial Sequence
  Description of Artificial Sequence:  Enzymatic Nucleic Acid
  misc_feature (18)..(25): n stands for any nucleotide and can be optionally absent
ucuagaaacugaugaggnnnnnnnnccgaaaaggcuuc

SEQ ID NO: 4842 - RNA, 38 nt, Artificial Sequence
  Description of Artificial Sequence:  Enzymatic Nucleic Acid
  misc_feature (18)..(25): n stands for any nucleotide and can be optionally absent
cuucuagacugaugaggnnnnnnnnccgaaauaaggcu

SEQ ID NO: 4843 - RNA, 38 nt, Artificial Sequence
  Description of Artificial Sequence:  Enzymatic Nucleic Acid
  misc_feature (18)..(25): n stands for any nucleotide and can be optionally absent
gcuucuagcugaugaggnnnnnnnnccgaaaauaaggc

SEQ ID NO: 4844 - RNA, 38 nt, Artificial Sequence
  Description of Artificial Sequence:  Enzymatic Nucleic Acid
  misc_feature (18)..(25): n stands for any nucleotide and can be optionally absent
ugcuucuacugaugaggnnnnnnnnccgaaaaauaagg

SEQ ID NO: 4845 - RNA, 38 nt, Artificial Sequence
  Description of Artificial Sequence:  Enzymatic Nucleic Acid
  misc_feature (18)..(25): n stands for any nucleotide and can be optionally absent
ugugcuuccugaugaggnnnnnnnnccgaaagaaauaa

SEQ ID NO: 4846 - RNA, 38 nt, Artificial Sequence
  Description of Artificial Sequence:  Enzymatic Nucleic Acid
  misc_feature (18)..(25): n stands for any nucleotide and can be optionally absent
gguauaaacugaugaggnnnnnnnnccgaaacacaugu

SEQ ID NO: 4847 - RNA, 38 nt, Artificial Sequence
  Description of Artificial Sequence:  Enzymatic Nucleic Acid
  misc_feature (18)..(25): n stands for any nucleotide and can be optionally absent
gggguauacugaugaggnnnnnnnnccgaaauacacau

SEQ ID NO: 4848 - RNA, 38 nt, Artificial Sequence
  Description of Artificial Sequence:  Enzymatic Nucleic Acid
  misc_feature (18)..(25): n stands for any nucleotide and can be optionally absent
ggggguaucugaugaggnnnnnnnnccgaaaauacaca

SEQ ID NO: 4849 - RNA, 38 nt, Artificial Sequence
  Description of Artificial Sequence:  Enzymatic Nucleic Acid
  misc_feature (18)..(25): n stands for any nucleotide and can be optionally absent
uggggguacugaugaggnnnnnnnnccgaaaaauacac

SEQ ID NO: 4850 - RNA, 38 nt, Artificial Sequence
  Description of Artificial Sequence:  Enzymatic Nucleic Acid
  misc_feature (18)..(25): n stands for any nucleotide and can be optionally absent
ccugggggcugaugaggnnnnnnnnccgaaauaaauac

SEQ ID NO: 4851 - RNA, 38 nt, Artificial Sequence
  Description of Artificial Sequence:  Enzymatic Nucleic Acid
  misc_feature (18)..(25): n stands for any nucleotide and can be optionally absent
gcaaaagccugaugaggnnnnnnnnccgaaaguuuccu

SEQ ID NO: 4852 - RNA, 38 nt, Artificial Sequence
  Description of Artificial Sequence:  Enzymatic Nucleic Acid
  misc_feature (18)..(25): n stands for any nucleotide and can be optionally absent
acuggcaacugaugaggnnnnnnnnccgaaagcuaguu

SEQ ID NO: 4853 - RNA, 38 nt, Artificial Sequence
  Description of Artificial Sequence:  Enzymatic Nucleic Acid
  misc_feature (18)..(25): n stands for any nucleotide and can be optionally absent
uacuggcacugaugaggnnnnnnnnccgaaaagcuagu

SEQ ID NO: 4854 - RNA, 38 nt, Artificial Sequence
  Description of Artificial Sequence:  Enzymatic Nucleic Acid
  misc_feature (18)..(25): n stands for any nucleotide and can be optionally absent
auacuggccugaugaggnnnnnnnnccgaaaaagcuag

SEQ ID NO: 4855 - RNA, 38 nt, Artificial Sequence
  Description of Artificial Sequence:  Enzymatic Nucleic Acid
  misc_feature (18)..(25): n stands for any nucleotide and can be optionally absent
augcauaacugaugaggnnnnnnnnccgaaacuggcaa

SEQ ID NO: 4856 - RNA, 38 nt, Artificial Sequence
  Description of Artificial Sequence:  Enzymatic Nucleic Acid
  misc_feature (18)..(25): n stands for any nucleotide and can be optionally absent
auaugcaucugaugaggnnnnnnnnccgaaauacuggc

SEQ ID NO: 4857 - RNA, 38 nt, Artificial Sequence
  Description of Artificial Sequence:  Enzymatic Nucleic Acid
  misc_feature (18)..(25): n stands for any nucleotide and can be optionally absent
uauaugcacugaugaggnnnnnnnnccgaaaauacugg

SEQ ID NO: 4858 - RNA, 38 nt, Artificial Sequence
  Description of Artificial Sequence:  Enzymatic Nucleic Acid
  misc_feature (18)..(25): n stands for any nucleotide and can be optionally absent
aacuuauacugaugaggnnnnnnnnccgaaaugcauaa

SEQ ID NO: 4859 - RNA, 38 nt, Artificial Sequence
  Description of Artificial Sequence:  Enzymatic Nucleic Acid
  misc_feature (18)..(25): n stands for any nucleotide and can be optionally absent
uaaacuuacugaugaggnnnnnnnnccgaaauaugcau

SEQ ID NO: 4860 - RNA, 38 nt, Artificial Sequence
  Description of Artificial Sequence:  Enzymatic Nucleic Acid
  misc_feature (18)..(25): n stands for any nucleotide and can be optionally absent
uguaaacucugaugaggnnnnnnnnccgaaauauaugc

SEQ ID NO: 4861 - RNA, 38 nt, Artificial Sequence
  Description of Artificial Sequence:  Enzymatic Nucleic Acid
  misc_feature (18)..(25): n stands for any nucleotide and can be optionally absent
aagguguacugaugaggnnnnnnnnccgaaacuuauau

SEQ ID NO: 4862 - RNA, 38 nt, Artificial Sequence
  Description of Artificial Sequence:  Enzymatic Nucleic Acid
  misc_feature (18)..(25): n stands for any nucleotide and can be optionally absent
aaaggugucugaugaggnnnnnnnnccgaaaacuuaua

SEQ ID NO: 4863 - RNA, 38 nt, Artificial Sequence
  Description of Artificial Sequence:  Enzymatic Nucleic Acid
  misc_feature (18)..(25): n stands for any nucleotide and can be optionally absent
uaaaggugcugaugaggnnnnnnnnccgaaaaacuuau

SEQ ID NO: 4864 - RNA, 38 nt, Artificial Sequence
  Description of Artificial Sequence:  Enzymatic Nucleic Acid
  misc_feature (18)..(25): n stands for any nucleotide and can be optionally absent
gaaagauacugaugaggnnnnnnnnccgaaagguguaa

SEQ ID NO: 4865 - RNA, 38 nt, Artificial Sequence
  Description of Artificial Sequence:  Enzymatic Nucleic Acid
  misc_feature (18)..(25): n stands for any nucleotide and can be optionally absent
ggaaagaucugaugaggnnnnnnnnccgaaaaggugua

SEQ ID NO: 4866 - RNA, 38 nt, Artificial Sequence
  Description of Artificial Sequence:  Enzymatic Nucleic Acid
  misc_feature (18)..(25): n stands for any nucleotide and can be optionally absent
uggaaagacugaugaggnnnnnnnnccgaaaaaggugu

SEQ ID NO: 4867 - RNA, 38 nt, Artificial Sequence
  Description of Artificial Sequence:  Enzymatic Nucleic Acid
  misc_feature (18)..(25): n stands for any nucleotide and can be optionally absent
cauggaaacugaugaggnnnnnnnnccgaaauaaaggu

SEQ ID NO: 4868 - RNA, 38 nt, Artificial Sequence
  Description of Artificial Sequence:  Enzymatic Nucleic Acid
  misc_feature (18)..(25): n stands for any nucleotide and can be optionally absent
cccauggacugaugaggnnnnnnnnccgaaagauaaag

SEQ ID NO: 4869 - RNA, 38 nt, Artificial Sequence
  Description of Artificial Sequence:  Enzymatic Nucleic Acid
  misc_feature (18)..(25): n stands for any nucleotide and can be optionally absent
ucccauggcugaugaggnnnnnnnnccgaaaagauaaa

SEQ ID NO: 4870 - RNA, 38 nt, Artificial Sequence
  Description of Artificial Sequence:  Enzymatic Nucleic Acid
  misc_feature (18)..(25): n stands for any nucleotide and can be optionally absent
cucccaugcugaugaggnnnnnnnnccgaaaaagauaa

SEQ ID NO: 4871 - RNA, 38 nt, Artificial Sequence
  Description of Artificial Sequence:  Enzymatic Nucleic Acid
  misc_feature (18)..(25): n stands for any nucleotide and can be optionally absent
aucacaaacugaugaggnnnnnnnnccgaaagcagcug

SEQ ID NO: 4872 - RNA, 38 nt, Artificial Sequence
  Description of Artificial Sequence:  Enzymatic Nucleic Acid
  misc_feature (18)..(25): n stands for any nucleotide and can be optionally absent
aaucacaacugaugaggnnnnnnnnccgaaaagcagcu

SEQ ID NO: 4873 - RNA, 38 nt, Artificial Sequence
  Description of Artificial Sequence:  Enzymatic Nucleic Acid
  misc_feature (18)..(25): n stands for any nucleotide and can be optionally absent
aaaucacacugaugaggnnnnnnnnccgaaaaagcagc

SEQ ID NO: 4874 - RNA, 38 nt, Artificial Sequence
  Description of Artificial Sequence:  Enzymatic Nucleic Acid
  misc_feature (18)..(25): n stands for any nucleotide and can be optionally absent
aaaaucaccugaugaggnnnnnnnnccgaaaaaagcag

SEQ ID NO: 4875 - RNA, 38 nt, Artificial Sequence
  Description of Artificial Sequence:  Enzymatic Nucleic Acid
  misc_feature (18)..(25): n stands for any nucleotide and can be optionally absent
auuaaaaacugaugaggnnnnnnnnccgaaaucacaaa

SEQ ID NO: 4876 - RNA, 38 nt, Artificial Sequence
  Description of Artificial Sequence:  Enzymatic Nucleic Acid
  misc_feature (18)..(25): n stands for any nucleotide and can be optionally absent
uauuaaaacugaugaggnnnnnnnnccgaaaaucacaa

SEQ ID NO: 4877 - RNA, 38 nt, Artificial Sequence
  Description of Artificial Sequence:  Enzymatic Nucleic Acid
  misc_feature (18)..(25): n stands for any nucleotide and can be optionally absent
cuauuaaacugaugaggnnnnnnnnccgaaaaaucaca

SEQ ID NO: 4878 - RNA, 38 nt, Artificial Sequence
  Description of Artificial Sequence:  Enzymatic Nucleic Acid
  misc_feature (18)..(25): n stands for any nucleotide and can be optionally absent
acuauuaacugaugaggnnnnnnnnccgaaaaaaucac

SEQ ID NO: 4879 - RNA, 38 nt, Artificial Sequence
  Description of Artificial Sequence:  Enzymatic Nucleic Acid
  misc_feature (18)..(25): n stands for any nucleotide and can be optionally absent
cacuauuacugaugaggnnnnnnnnccgaaaaaaauca

SEQ ID NO: 4880 - RNA, 38 nt, Artificial Sequence
  Description of Artificial Sequence:  Enzymatic Nucleic Acid
  misc_feature (18)..(25): n stands for any nucleotide and can be optionally absent
gcacuauucugaugaggnnnnnnnnccgaaaaaaaauc

SEQ ID NO: 4881 - RNA, 38 nt, Artificial Sequence
  Description of Artificial Sequence:  Enzymatic Nucleic Acid
  misc_feature (18)..(25): n stands for any nucleotide and can be optionally absent
agcacuaucugaugaggnnnnnnnnccgaaaaaaaaau

SEQ ID NO: 4882 - RNA, 38 nt, Artificial Sequence
  Description of Artificial Sequence:  Enzymatic Nucleic Acid
  misc_feature (18)..(25): n stands for any nucleotide and can be optionally absent
aaaagcaccugaugaggnnnnnnnnccgaaauuaaaaa

SEQ ID NO: 4883 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaagcacuau

SEQ ID NO: 4884 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaagcacua

SEQ ID NO: 4885 - RNA, 38 nt, Artificial Sequence
  Description of Artificial Sequence:  Enzymatic Nucleic Acid
  misc_feature (18)..(25): n stands for any nucleotide and can be optionally absent
caaaaaaacugaugaggnnnnnnnnccgaaaaagcacu

SEQ ID NO: 4886 - RNA, 38 nt, Artificial Sequence
  Description of Artificial Sequence:  Enzymatic Nucleic Acid
  misc_feature (18)..(25): n stands for any nucleotide and can be optionally absent
ucaaaaaacugaugaggnnnnnnnnccgaaaaaagcac

SEQ ID NO: 4887 - RNA, 38 nt, Artificial Sequence
  Description of Artificial Sequence:  Enzymatic Nucleic Acid
  misc_feature (18)..(25): n stands for any nucleotide and can be optionally absent
gucaaaaacugaugaggnnnnnnnnccgaaaaaaagca

SEQ ID NO: 4888 - RNA, 38 nt, Artificial Sequence
  Description of Artificial Sequence:  Enzymatic Nucleic Acid
  misc_feature (18)..(25): n stands for any nucleotide and can be optionally absent
agucaaaacugaugaggnnnnnnnnccgaaaaaaaagc

SEQ ID NO: 4889 - RNA, 38 nt, Artificial Sequence
  Description of Artificial Sequence:  Enzymatic Nucleic Acid
  misc_feature (18)..(25): n stands for any nucleotide and can be optionally absent
uagucaaacugaugaggnnnnnnnnccgaaaaaaaaag

SEQ ID NO: 4890 - RNA, 38 nt, Artificial Sequence
  Description of Artificial Sequence:  Enzymatic Nucleic Acid
  misc_feature (18)..(25): n stands for any nucleotide and can be optionally absent
uuagucaacugaugaggnnnnnnnnccgaaaaaaaaaa

SEQ ID NO: 4891 - RNA, 38 nt, Artificial Sequence
  Description of Artificial Sequence:  Enzymatic Nucleic Acid
  misc_feature (18)..(25): n stands for any nucleotide and can be optionally absent
guuagucacugaugaggnnnnnnnnccgaaaaaaaaaa

SEQ ID NO: 4892 - RNA, 38 nt, Artificial Sequence
  Description of Artificial Sequence:  Enzymatic Nucleic Acid
  misc_feature (18)..(25): n stands for any nucleotide and can be optionally absent
uguuaguccugaugaggnnnnnnnnccgaaaaaaaaaa

SEQ ID NO: 4893 - RNA, 38 nt, Artificial Sequence
  Description of Artificial Sequence:  Enzymatic Nucleic Acid
  misc_feature (18)..(25): n stands for any nucleotide and can be optionally absent
auucuugucugaugaggnnnnnnnnccgaaagucaaaa

SEQ ID NO: 4894 - RNA, 38 nt, Artificial Sequence
  Description of Artificial Sequence:  Enzymatic Nucleic Acid
  misc_feature (18)..(25): n stands for any nucleotide and can be optionally absent
ucuggagucugaugaggnnnnnnnnccgaaacauucuu

SEQ ID NO: 4895 - RNA, 38 nt, Artificial Sequence
  Description of Artificial Sequence:  Enzymatic Nucleic Acid
  misc_feature (18)..(25): n stands for any nucleotide and can be optionally absent
ucuaucugcugaugaggnnnnnnnnccgaaaguuacau

SEQ ID NO: 4896 - RNA, 38 nt, Artificial Sequence
  Description of Artificial Sequence:  Enzymatic Nucleic Acid
  misc_feature (18)..(25): n stands for any nucleotide and can be optionally absent
uauuucuccugaugaggnnnnnnnnccgaaaucuggag

SEQ ID NO: 4897 - RNA, 38 nt, Artificial Sequence
  Description of Artificial Sequence:  Enzymatic Nucleic Acid
  misc_feature (18)..(25): n stands for any nucleotide and can be optionally absent
cuugucaccugaugaggnnnnnnnnccgaaauuucucu

SEQ ID NO: 4898 - RNA, 38 nt, Artificial Sequence
  Description of Artificial Sequence:  Enzymatic Nucleic Acid
  misc_feature (18)..(25): n stands for any nucleotide and can be optionally absent
uuuagcagcugaugaggnnnnnnnnccgaaaguguucu

SEQ ID NO: 4899 - RNA, 38 nt, Artificial Sequence
  Description of Artificial Sequence:  Enzymatic Nucleic Acid
  misc_feature (18)..(25): n stands for any nucleotide and can be optionally absent
ugaggauucugaugaggnnnnnnnnccgaaagcaguag

SEQ ID NO: 4900 - RNA, 38 nt, Artificial Sequence
  Description of Artificial Sequence:  Enzymatic Nucleic Acid
  misc_feature (18)..(25): n stands for any nucleotide and can be optionally absent
aacaugagcugaugaggnnnnnnnnccgaaauuuagca

SEQ ID NO: 4901 - RNA, 38 nt, Artificial Sequence
  Description of Artificial Sequence:  Enzymatic Nucleic Acid
  misc_feature (18)..(25): n stands for any nucleotide and can be optionally absent
aguaacaucugaugaggnnnnnnnnccgaaaggauuua

SEQ ID NO: 4902 - RNA, 38 nt, Artificial Sequence
  Description of Artificial Sequence:  Enzymatic Nucleic Acid
  misc_feature (18)..(25): n stands for any nucleotide and can be optionally absent
cacugagucugaugaggnnnnnnnnccgaaacaugagg

SEQ ID NO: 4903 - RNA, 38 nt, Artificial Sequence
  Description of Artificial Sequence:  Enzymatic Nucleic Acid
  misc_feature (18)..(25): n stands for any nucleotide and can be optionally absent
acacugagcugaugaggnnnnnnnnccgaaaacaugag

SEQ ID NO: 4904 - RNA, 38 nt, Artificial Sequence
  Description of Artificial Sequence:  Enzymatic Nucleic Acid
  misc_feature (18)..(25): n stands for any nucleotide and can be optionally absent
cuaacacucugaugaggnnnnnnnnccgaaaguaacau

SEQ ID NO: 4905 - RNA, 38 nt, Artificial Sequence
  Description of Artificial Sequence:  Enzymatic Nucleic Acid
  misc_feature (18)..(25): n stands for any nucleotide and can be optionally absent
auuucucucugaugaggnnnnnnnnccgaaacacugag

SEQ ID NO: 4906 - RNA, 38 nt, Artificial Sequence
  Description of Artificial Sequence:  Enzymatic Nucleic Acid
  misc_feature (18)..(25): n stands for any nucleotide and can be optionally absent
gauuucuccugaugaggnnnnnnnnccgaaaacacuga

SEQ ID NO: 4907 - RNA, 38 nt, Artificial Sequence
  Description of Artificial Sequence:  Enzymatic Nucleic Acid
  misc_feature (18)..(25): n stands for any nucleotide and can be optionally absent
uuaggaagcugaugaggnnnnnnnnccgaaauuucucu

SEQ ID NO: 4908 - RNA, 38 nt, Artificial Sequence
  Description of Artificial Sequence:  Enzymatic Nucleic Acid
  misc_feature (18)..(25): n stands for any nucleotide and can be optionally absent
gguuuaggcugaugaggnnnnnnnnccgaaaggauuuc

SEQ ID NO: 4909 - RNA, 38 nt, Artificial Sequence
  Description of Artificial Sequence:  Enzymatic Nucleic Acid
  misc_feature (18)..(25): n stands for any nucleotide and can be optionally absent
ggguuuagcugaugaggnnnnnnnnccgaaaaggauuu

SEQ ID NO: 4910 - RNA, 38 nt, Artificial Sequence
  Description of Artificial Sequence:  Enzymatic Nucleic Acid
  misc_feature (18)..(25): n stands for any nucleotide and can be optionally absent
auuggguucugaugaggnnnnnnnnccgaaaggaagga

SEQ ID NO: 4911 - RNA, 38 nt, Artificial Sequence
  Description of Artificial Sequence:  Enzymatic Nucleic Acid
  misc_feature (18)..(25): n stands for any nucleotide and can be optionally absent
gagcagggcugaugaggnnnnnnnnccgaaagucauug

SEQ ID NO: 4912 - RNA, 38 nt, Artificial Sequence
  Description of Artificial Sequence:  Enzymatic Nucleic Acid
  misc_feature (18)..(25): n stands for any nucleotide and can be optionally absent
ggagcaggcugaugaggnnnnnnnnccgaaaagucauu

SEQ ID NO: 4913 - RNA, 38 nt, Artificial Sequence
  Description of Artificial Sequence:  Enzymatic Nucleic Acid
  misc_feature (18)..(25): n stands for any nucleotide and can be optionally absent
ggggguugcugaugaggnnnnnnnnccgaaagcaggga

SEQ ID NO: 4914 - RNA, 38 nt, Artificial Sequence
  Description of Artificial Sequence:  Enzymatic Nucleic Acid
  misc_feature (18)..(25): n stands for any nucleotide and can be optionally absent
cgugcccucugaugaggnnnnnnnnccgaaagguggcg

SEQ ID NO: 4915 - RNA, 38 nt, Artificial Sequence
  Description of Artificial Sequence:  Enzymatic Nucleic Acid
  misc_feature (18)..(25): n stands for any nucleotide and can be optionally absent
cucaaucacugaugaggnnnnnnnnccgaaacuggucc

SEQ ID NO: 4916 - RNA, 38 nt, Artificial Sequence
  Description of Artificial Sequence:  Enzymatic Nucleic Acid
  misc_feature (18)..(25): n stands for any nucleotide and can be optionally absent
ccucaauccugaugaggnnnnnnnnccgaaaacugguc

SEQ ID NO: 4917 - RNA, 38 nt, Artificial Sequence
  Description of Artificial Sequence:  Enzymatic Nucleic Acid
  misc_feature (18)..(25): n stands for any nucleotide and can be optionally absent
agcuccuccugaugaggnnnnnnnnccgaaaucaaacu

SEQ ID NO: 4918 - RNA, 38 nt, Artificial Sequence
  Description of Artificial Sequence:  Enzymatic Nucleic Acid
  misc_feature (18)..(25): n stands for any nucleotide and can be optionally absent
cauugggucugaugaggnnnnnnnnccgaaaucagugc

SEQ ID NO: 4919 - RNA, 38 nt, Artificial Sequence
  Description of Artificial Sequence:  Enzymatic Nucleic Acid
  misc_feature (18)..(25): n stands for any nucleotide and can be optionally absent
ggguacgucugaugaggnnnnnnnnccgaaaugcauug

SEQ ID NO: 4920 - RNA, 38 nt, Artificial Sequence
  Description of Artificial Sequence:  Enzymatic Nucleic Acid
  misc_feature (18)..(25): n stands for any nucleotide and can be optionally absent
caguggggcugaugaggnnnnnnnnccgaaacgugaug

SEQ ID NO: 4921 - RNA, 38 nt, Artificial Sequence
  Description of Artificial Sequence:  Enzymatic Nucleic Acid
  misc_feature (18)..(25): n stands for any nucleotide and can be optionally absent
cuggggcucugaugaggnnnnnnnnccgaaacgggcuu

SEQ ID NO: 4922 - RNA, 38 nt, Artificial Sequence
  Description of Artificial Sequence:  Enzymatic Nucleic Acid
  misc_feature (18)..(25): n stands for any nucleotide and can be optionally absent
ccuggggccugaugaggnnnnnnnnccgaaaacgggcu

SEQ ID NO: 4923 - RNA, 38 nt, Artificial Sequence
  Description of Artificial Sequence:  Enzymatic Nucleic Acid
  misc_feature (18)..(25): n stands for any nucleotide and can be optionally absent
cagccagucugaugaggnnnnnnnnccgaaauccccug

SEQ ID NO: 4924 - RNA, 38 nt, Artificial Sequence
  Description of Artificial Sequence:  Enzymatic Nucleic Acid
  misc_feature (18)..(25): n stands for any nucleotide and can be optionally absent
acucccgacugaugaggnnnnnnnnccgaaauguugcu

SEQ ID NO: 4925 - RNA, 38 nt, Artificial Sequence
  Description of Artificial Sequence:  Enzymatic Nucleic Acid
  misc_feature (18)..(25): n stands for any nucleotide and can be optionally absent
ggacuccccugaugaggnnnnnnnnccgaaagauguug

SEQ ID NO: 4926 - RNA, 38 nt, Artificial Sequence
  Description of Artificial Sequence:  Enzymatic Nucleic Acid
  misc_feature (18)..(25): n stands for any nucleotide and can be optionally absent
ugcuagagcugaugaggnnnnnnnnccgaaacucccga

SEQ ID NO: 4927 - RNA, 38 nt, Artificial Sequence
  Description of Artificial Sequence:  Enzymatic Nucleic Acid
  misc_feature (18)..(25): n stands for any nucleotide and can be optionally absent
gccugcuacugaugaggnnnnnnnnccgaaaggacucc

SEQ ID NO: 4928 - RNA, 38 nt, Artificial Sequence
  Description of Artificial Sequence:  Enzymatic Nucleic Acid
  misc_feature (18)..(25): n stands for any nucleotide and can be optionally absent
aggccugccugaugaggnnnnnnnnccgaaagaggacu

SEQ ID NO: 4929 - RNA, 38 nt, Artificial Sequence
  Description of Artificial Sequence:  Enzymatic Nucleic Acid
  misc_feature (18)..(25): n stands for any nucleotide and can be optionally absent
acaugucucugaugaggnnnnnnnnccgaaaggccugc

SEQ ID NO: 4930 - RNA, 38 nt, Artificial Sequence
  Description of Artificial Sequence:  Enzymatic Nucleic Acid
  misc_feature (18)..(25): n stands for any nucleotide and can be optionally absent
gcgucucacugaugaggnnnnnnnnccgaaauucuuuc

SEQ ID NO: 4931 - RNA, 38 nt, Artificial Sequence
  Description of Artificial Sequence:  Enzymatic Nucleic Acid
  misc_feature (18)..(25): n stands for any nucleotide and can be optionally absent
ugcgucuccugaugaggnnnnnnnnccgaaaauucuuu

SEQ ID NO: 4932 - RNA, 38 nt, Artificial Sequence
  Description of Artificial Sequence:  Enzymatic Nucleic Acid
  misc_feature (18)..(25): n stands for any nucleotide and can be optionally absent
gcauugcucugaugaggnnnnnnnnccgaaagccccgu

SEQ ID NO: 4933 - RNA, 38 nt, Artificial Sequence
  Description of Artificial Sequence:  Enzymatic Nucleic Acid
  misc_feature (18)..(25): n stands for any nucleotide and can be optionally absent
gccacugacugaugaggnnnnnnnnccgaaauggcauu

SEQ ID NO: 4934 - RNA, 38 nt, Artificial Sequence
  Description of Artificial Sequence:  Enzymatic Nucleic Acid
  misc_feature (18)..(25): n stands for any nucleotide and can be optionally absent
agccacugcugaugaggnnnnnnnnccgaaaauggcau

SEQ ID NO: 4935 - RNA, 38 nt, Artificial Sequence
  Description of Artificial Sequence:  Enzymatic Nucleic Acid
  misc_feature (18)..(25): n stands for any nucleotide and can be optionally absent
aagccacucugaugaggnnnnnnnnccgaaaaauggca

SEQ ID NO: 4936 - RNA, 38 nt, Artificial Sequence
  Description of Artificial Sequence:  Enzymatic Nucleic Acid
  misc_feature (18)..(25): n stands for any nucleotide and can be optionally absent
gagcugggcugaugaggnnnnnnnnccgaaagccacug

SEQ ID NO: 4937 - RNA, 38 nt, Artificial Sequence
  Description of Artificial Sequence:  Enzymatic Nucleic Acid
  misc_feature (18)..(25): n stands for any nucleotide and can be optionally absent
agagcuggcugaugaggnnnnnnnnccgaaaagccacu

SEQ ID NO: 4938 - RNA, 38 nt, Artificial Sequence
  Description of Artificial Sequence:  Enzymatic Nucleic Acid
  misc_feature (18)..(25): n stands for any nucleotide and can be optionally absent
aagggucacugaugaggnnnnnnnnccgaaagcuggga

SEQ ID NO: 4939 - RNA, 38 nt, Artificial Sequence
  Description of Artificial Sequence:  Enzymatic Nucleic Acid
  misc_feature (18)..(25): n stands for any nucleotide and can be optionally absent
aaauguagcugaugaggnnnnnnnnccgaaagggucag

SEQ ID NO: 4940 - RNA, 38 nt, Artificial Sequence
  Description of Artificial Sequence:  Enzymatic Nucleic Acid
  misc_feature (18)..(25): n stands for any nucleotide and can be optionally absent
caaauguacugaugaggnnnnnnnnccgaaaaggguca

SEQ ID NO: 4941 - RNA, 38 nt, Artificial Sequence
  Description of Artificial Sequence:  Enzymatic Nucleic Acid
  misc_feature (18)..(25): n stands for any nucleotide and can be optionally absent
cucaaaugcugaugaggnnnnnnnnccgaaagaagggu

SEQ ID NO: 4942 - RNA, 38 nt, Artificial Sequence
  Description of Artificial Sequence:  Enzymatic Nucleic Acid
  misc_feature (18)..(25): n stands for any nucleotide and can be optionally absent
ggcccucacugaugaggnnnnnnnnccgaaauguagaa

SEQ ID NO: 4943 - RNA, 38 nt, Artificial Sequence
  Description of Artificial Sequence:  Enzymatic Nucleic Acid
  misc_feature (18)..(25): n stands for any nucleotide and can be optionally absent
gggcccuccugaugaggnnnnnnnnccgaaaauguaga

SEQ ID NO: 4944 - RNA, 38 nt, Artificial Sequence
  Description of Artificial Sequence:  Enzymatic Nucleic Acid
  misc_feature (18)..(25): n stands for any nucleotide and can be optionally absent
auccagaacugaugaggnnnnnnnnccgaaaugucccc

SEQ ID NO: 4945 - RNA, 38 nt, Artificial Sequence
  Description of Artificial Sequence:  Enzymatic Nucleic Acid
  misc_feature (18)..(25): n stands for any nucleotide and can be optionally absent
aauccagacugaugaggnnnnnnnnccgaaaauguccc

SEQ ID NO: 4946 - RNA, 38 nt, Artificial Sequence
  Description of Artificial Sequence:  Enzymatic Nucleic Acid
  misc_feature (18)..(25): n stands for any nucleotide and can be optionally absent
gaauccagcugaugaggnnnnnnnnccgaaaaaugucc

SEQ ID NO: 4947 - RNA, 38 nt, Artificial Sequence
  Description of Artificial Sequence:  Enzymatic Nucleic Acid
  misc_feature (18)..(25): n stands for any nucleotide and can be optionally absent
agaauccacugaugaggnnnnnnnnccgaaaaaauguc

SEQ ID NO: 4948 - RNA, 38 nt, Artificial Sequence
  Description of Artificial Sequence:  Enzymatic Nucleic Acid
  misc_feature (18)..(25): n stands for any nucleotide and can be optionally absent
ccucccagcugaugaggnnnnnnnnccgaaauccagaa

SEQ ID NO: 4949 - RNA, 38 nt, Artificial Sequence
  Description of Artificial Sequence:  Enzymatic Nucleic Acid
  misc_feature (18)..(25): n stands for any nucleotide and can be optionally absent
gccucccacugaugaggnnnnnnnnccgaaaauccaga

SEQ ID NO: 4950 - RNA, 38 nt, Artificial Sequence
  Description of Artificial Sequence:  Enzymatic Nucleic Acid
  misc_feature (18)..(25): n stands for any nucleotide and can be optionally absent
aaaaaagacugaugaggnnnnnnnnccgaaauuugucc

SEQ ID NO: 4951 - RNA, 38 nt, Artificial Sequence
  Description of Artificial Sequence:  Enzymatic Nucleic Acid
  misc_feature (18)..(25): n stands for any nucleotide and can be optionally absent
ccaaaaaacugaugaggnnnnnnnnccgaaauauuugu

SEQ ID NO: 4952 - RNA, 38 nt, Artificial Sequence
  Description of Artificial Sequence:  Enzymatic Nucleic Acid
  misc_feature (18)..(25): n stands for any nucleotide and can be optionally absent
uuccaaaacugaugaggnnnnnnnnccgaaagauauuu

SEQ ID NO: 4953 - RNA, 38 nt, Artificial Sequence
  Description of Artificial Sequence:  Enzymatic Nucleic Acid
  misc_feature (18)..(25): n stands for any nucleotide and can be optionally absent
guuccaaacugaugaggnnnnnnnnccgaaaagauauu

SEQ ID NO: 4954 - RNA, 38 nt, Artificial Sequence
  Description of Artificial Sequence:  Enzymatic Nucleic Acid
  misc_feature (18)..(25): n stands for any nucleotide and can be optionally absent
aguuccaacugaugaggnnnnnnnnccgaaaaagauau

SEQ ID NO: 4955 - RNA, 38 nt, Artificial Sequence
  Description of Artificial Sequence:  Enzymatic Nucleic Acid
  misc_feature (18)..(25): n stands for any nucleotide and can be optionally absent
uaguuccacugaugaggnnnnnnnnccgaaaaaagaua

SEQ ID NO: 4956 - RNA, 38 nt, Artificial Sequence
  Description of Artificial Sequence:  Enzymatic Nucleic Acid
  misc_feature (18)..(25): n stands for any nucleotide and can be optionally absent
uuaguucccugaugaggnnnnnnnnccgaaaaaaagau

SEQ ID NO: 4957 - RNA, 38 nt, Artificial Sequence
  Description of Artificial Sequence:  Enzymatic Nucleic Acid
  misc_feature (18)..(25): n stands for any nucleotide and can be optionally absent
auuugcuucugaugaggnnnnnnnnccgaaaguuccaa

SEQ ID NO: 4958 - RNA, 38 nt, Artificial Sequence
  Description of Artificial Sequence:  Enzymatic Nucleic Acid
  misc_feature (18)..(25): n stands for any nucleotide and can be optionally absent
aggucuaacugaugaggnnnnnnnnccgaaauuugcuu

SEQ ID NO: 4959 - RNA, 38 nt, Artificial Sequence
  Description of Artificial Sequence:  Enzymatic Nucleic Acid
  misc_feature (18)..(25): n stands for any nucleotide and can be optionally absent
aaggucuacugaugaggnnnnnnnnccgaaaauuugcu

SEQ ID NO: 4960 - RNA, 38 nt, Artificial Sequence
  Description of Artificial Sequence:  Enzymatic Nucleic Acid
  misc_feature (18)..(25): n stands for any nucleotide and can be optionally absent
aaaggucucugaugaggnnnnnnnnccgaaaaauuugc

SEQ ID NO: 4961 - RNA, 38 nt, Artificial Sequence
  Description of Artificial Sequence:  Enzymatic Nucleic Acid
  misc_feature (18)..(25): n stands for any nucleotide and can be optionally absent
uaaagguccugaugaggnnnnnnnnccgaaaaaauuug

SEQ ID NO: 4962 - RNA, 38 nt, Artificial Sequence
  Description of Artificial Sequence:  Enzymatic Nucleic Acid
  misc_feature (18)..(25): n stands for any nucleotide and can be optionally absent
cauagguacugaugaggnnnnnnnnccgaaaggucuaa

SEQ ID NO: 4963 - RNA, 38 nt, Artificial Sequence
  Description of Artificial Sequence:  Enzymatic Nucleic Acid
  misc_feature (18)..(25): n stands for any nucleotide and can be optionally absent
ccauaggucugaugaggnnnnnnnnccgaaaaggucua

SEQ ID NO: 4964 - RNA, 38 nt, Artificial Sequence
  Description of Artificial Sequence:  Enzymatic Nucleic Acid
  misc_feature (18)..(25): n stands for any nucleotide and can be optionally absent
uccauaggcugaugaggnnnnnnnnccgaaaaaggucu

SEQ ID NO: 4965 - RNA, 38 nt, Artificial Sequence
  Description of Artificial Sequence:  Enzymatic Nucleic Acid
  misc_feature (18)..(25): n stands for any nucleotide and can be optionally absent
cacuuccacugaugaggnnnnnnnnccgaaagguaaag

SEQ ID NO: 4966 - RNA, 38 nt, Artificial Sequence
  Description of Artificial Sequence:  Enzymatic Nucleic Acid
  misc_feature (18)..(25): n stands for any nucleotide and can be optionally absent
ggacauagcugaugaggnnnnnnnnccgaaaccacuuc

SEQ ID NO: 4967 - RNA, 38 nt, Artificial Sequence
  Description of Artificial Sequence:  Enzymatic Nucleic Acid
  misc_feature (18)..(25): n stands for any nucleotide and can be optionally absent
uggacauacugaugaggnnnnnnnnccgaaaaccacuu

SEQ ID NO: 4968 - RNA, 38 nt, Artificial Sequence
  Description of Artificial Sequence:  Enzymatic Nucleic Acid
  misc_feature (18)..(25): n stands for any nucleotide and can be optionally absent
aauggacacugaugaggnnnnnnnnccgaaagaaccac

SEQ ID NO: 4969 - RNA, 38 nt, Artificial Sequence
  Description of Artificial Sequence:  Enzymatic Nucleic Acid
  misc_feature (18)..(25): n stands for any nucleotide and can be optionally absent
ugagaaugcugaugaggnnnnnnnnccgaaacauagaa

SEQ ID NO: 4970 - RNA, 38 nt, Artificial Sequence
  Description of Artificial Sequence:  Enzymatic Nucleic Acid
  misc_feature (18)..(25): n stands for any nucleotide and can be optionally absent
cgaaugagcugaugaggnnnnnnnnccgaaauggacau

SEQ ID NO: 4971 - RNA, 38 nt, Artificial Sequence
  Description of Artificial Sequence:  Enzymatic Nucleic Acid
  misc_feature (18)..(25): n stands for any nucleotide and can be optionally absent
acgaaugacugaugaggnnnnnnnnccgaaaauggaca

SEQ ID NO: 4972 - RNA, 38 nt, Artificial Sequence
  Description of Artificial Sequence:  Enzymatic Nucleic Acid
  misc_feature (18)..(25): n stands for any nucleotide and can be optionally absent
ccacgaaucugaugaggnnnnnnnnccgaaagaaugga

SEQ ID NO: 4973 - RNA, 38 nt, Artificial Sequence
  Description of Artificial Sequence:  Enzymatic Nucleic Acid
  misc_feature (18)..(25): n stands for any nucleotide and can be optionally absent
augccacgcugaugaggnnnnnnnnccgaaaugagaau

SEQ ID NO: 4974 - RNA, 38 nt, Artificial Sequence
  Description of Artificial Sequence:  Enzymatic Nucleic Acid
  misc_feature (18)..(25): n stands for any nucleotide and can be optionally absent
caugccaccugaugaggnnnnnnnnccgaaaaugagaa

SEQ ID NO: 4975 - RNA, 38 nt, Artificial Sequence
  Description of Artificial Sequence:  Enzymatic Nucleic Acid
  misc_feature (18)..(25): n stands for any nucleotide and can be optionally absent
caaaucaacugaugaggnnnnnnnnccgaaacaugcca

SEQ ID NO: 4976 - RNA, 38 nt, Artificial Sequence
  Description of Artificial Sequence:  Enzymatic Nucleic Acid
  misc_feature (18)..(25): n stands for any nucleotide and can be optionally absent
acaaaucacugaugaggnnnnnnnnccgaaaacaugcc

SEQ ID NO: 4977 - RNA, 38 nt, Artificial Sequence
  Description of Artificial Sequence:  Enzymatic Nucleic Acid
  misc_feature (18)..(25): n stands for any nucleotide and can be optionally absent
uacaaauccugaugaggnnnnnnnnccgaaaaacaugc

SEQ ID NO: 4978 - RNA, 38 nt, Artificial Sequence
  Description of Artificial Sequence:  Enzymatic Nucleic Acid
  misc_feature (18)..(25): n stands for any nucleotide and can be optionally absent
gugcuacacugaugaggnnnnnnnnccgaaaucaaaac

SEQ ID NO: 4979 - RNA, 38 nt, Artificial Sequence
  Description of Artificial Sequence:  Enzymatic Nucleic Acid
  misc_feature (18)..(25): n stands for any nucleotide and can be optionally absent
agugcuaccugaugaggnnnnnnnnccgaaaaucaaaa

SEQ ID NO: 4980 - RNA, 38 nt, Artificial Sequence
  Description of Artificial Sequence:  Enzymatic Nucleic Acid
  misc_feature (18)..(25): n stands for any nucleotide and can be optionally absent
cucagugccugaugaggnnnnnnnnccgaaacaaauca

SEQ ID NO: 4981 - RNA, 38 nt, Artificial Sequence
  Description of Artificial Sequence:  Enzymatic Nucleic Acid
  misc_feature (18)..(25): n stands for any nucleotide and can be optionally absent
ucagaguucugaugaggnnnnnnnnccgaaagugccac

SEQ ID NO: 4982 - RNA, 38 nt, Artificial Sequence
  Description of Artificial Sequence:  Enzymatic Nucleic Acid
  misc_feature (18)..(25): n stands for any nucleotide and can be optionally absent
ugggcucacugaugaggnnnnnnnnccgaaaguugagu

SEQ ID NO: 4983 - RNA, 38 nt, Artificial Sequence
  Description of Artificial Sequence:  Enzymatic Nucleic Acid
  misc_feature (18)..(25): n stands for any nucleotide and can be optionally absent
gccaaaagcugaugaggnnnnnnnnccgaaaugggcuc

SEQ ID NO: 4984 - RNA, 38 nt, Artificial Sequence
  Description of Artificial Sequence:  Enzymatic Nucleic Acid
  misc_feature (18)..(25): n stands for any nucleotide and can be optionally absent
ggagccaacugaugaggnnnnnnnnccgaaaguauggg

SEQ ID NO: 4985 - RNA, 38 nt, Artificial Sequence
  Description of Artificial Sequence:  Enzymatic Nucleic Acid
  misc_feature (18)..(25): n stands for any nucleotide and can be optionally absent
aggagccacugaugaggnnnnnnnnccgaaaaguaugg

SEQ ID NO: 4986 - RNA, 38 nt, Artificial Sequence
  Description of Artificial Sequence:  Enzymatic Nucleic Acid
  misc_feature (18)..(25): n stands for any nucleotide and can be optionally absent
gaggagcccugaugaggnnnnnnnnccgaaaaaguaug

SEQ ID NO: 4987 - RNA, 38 nt, Artificial Sequence
  Description of Artificial Sequence:  Enzymatic Nucleic Acid
  misc_feature (18)..(25): n stands for any nucleotide and can be optionally absent
uacuagagcugaugaggnnnnnnnnccgaaagccaaaa

SEQ ID NO: 4988 - RNA, 38 nt, Artificial Sequence
  Description of Artificial Sequence:  Enzymatic Nucleic Acid
  misc_feature (18)..(25): n stands for any nucleotide and can be optionally absent
ucuuacuacugaugaggnnnnnnnnccgaaaggagcca

SEQ ID NO: 4989 - RNA, 38 nt, Artificial Sequence
  Description of Artificial Sequence:  Enzymatic Nucleic Acid
  misc_feature (18)..(25): n stands for any nucleotide and can be optionally absent
caucuuaccugaugaggnnnnnnnnccgaaagaggagc

SEQ ID NO: 4990 - RNA, 38 nt, Artificial Sequence
  Description of Artificial Sequence:  Enzymatic Nucleic Acid
  misc_feature (18)..(25): n stands for any nucleotide and can be optionally absent
gugcaucucugaugaggnnnnnnnnccgaaacuagagg

SEQ ID NO: 4991 - RNA, 38 nt, Artificial Sequence
  Description of Artificial Sequence:  Enzymatic Nucleic Acid
  misc_feature (18)..(25): n stands for any nucleotide and can be optionally absent
cucuggcucugaugaggnnnnnnnnccgaaaguuuuca

SEQ ID NO: 4992 - RNA, 38 nt, Artificial Sequence
  Description of Artificial Sequence:  Enzymatic Nucleic Acid
  misc_feature (18)..(25): n stands for any nucleotide and can be optionally absent
acucuggccugaugaggnnnnnnnnccgaaaaguuuuc

SEQ ID NO: 4993 - RNA, 38 nt, Artificial Sequence
  Description of Artificial Sequence:  Enzymatic Nucleic Acid
  misc_feature (18)..(25): n stands for any nucleotide and can be optionally absent
gacaaccucugaugaggnnnnnnnnccgaaacucuggc

SEQ ID NO: 4994 - RNA, 38 nt, Artificial Sequence
  Description of Artificial Sequence:  Enzymatic Nucleic Acid
  misc_feature (18)..(25): n stands for any nucleotide and can be optionally absent
agacaacccugaugaggnnnnnnnnccgaaaacucugg

SEQ ID NO: 4995 - RNA, 38 nt, Artificial Sequence
  Description of Artificial Sequence:  Enzymatic Nucleic Acid
  misc_feature (18)..(25): n stands for any nucleotide and can be optionally absent
cuggagaccugaugaggnnnnnnnnccgaaaccuaacu

SEQ ID NO: 4996 - RNA, 38 nt, Artificial Sequence
  Description of Artificial Sequence:  Enzymatic Nucleic Acid
  misc_feature (18)..(25): n stands for any nucleotide and can be optionally absent
ggccuggacugaugaggnnnnnnnnccgaaacaaccua

SEQ ID NO: 4997 - RNA, 38 nt, Artificial Sequence
  Description of Artificial Sequence:  Enzymatic Nucleic Acid
  misc_feature (18)..(25): n stands for any nucleotide and can be optionally absent
auggccugcugaugaggnnnnnnnnccgaaagacaacc

SEQ ID NO: 4998 - RNA, 38 nt, Artificial Sequence
  Description of Artificial Sequence:  Enzymatic Nucleic Acid
  misc_feature (18)..(25): n stands for any nucleotide and can be optionally absent
uucagugucugaugaggnnnnnnnnccgaaaggccauc

SEQ ID NO: 4999 - RNA, 38 nt, Artificial Sequence
  Description of Artificial Sequence:  Enzymatic Nucleic Acid
  misc_feature (18)..(25): n stands for any nucleotide and can be optionally absent
uuucagugcugaugaggnnnnnnnnccgaaaaggccau

SEQ ID NO: 5000 - RNA, 38 nt, Artificial Sequence
  Description of Artificial Sequence:  Enzymatic Nucleic Acid
  misc_feature (18)..(25): n stands for any nucleotide and can be optionally absent
uagaaugucugaugaggnnnnnnnnccgaaacauuuuc

SEQ ID NO: 5001 - RNA, 38 nt, Artificial Sequence
  Description of Artificial Sequence:  Enzymatic Nucleic Acid
  misc_feature (18)..(25): n stands for any nucleotide and can be optionally absent
caaaauagcugaugaggnnnnnnnnccgaaaugugaca

SEQ ID NO: 5002 - RNA, 38 nt, Artificial Sequence
  Description of Artificial Sequence:  Enzymatic Nucleic Acid
  misc_feature (18)..(25): n stands for any nucleotide and can be optionally absent
ccaaaauacugaugaggnnnnnnnnccgaaaaugugac

SEQ ID NO: 5003 - RNA, 38 nt, Artificial Sequence
  Description of Artificial Sequence:  Enzymatic Nucleic Acid
  misc_feature (18)..(25): n stands for any nucleotide and can be optionally absent
acccaaaacugaugaggnnnnnnnnccgaaagaaugug

SEQ ID NO: 5004 - RNA, 38 nt, Artificial Sequence
  Description of Artificial Sequence:  Enzymatic Nucleic Acid
  misc_feature (18)..(25): n stands for any nucleotide and can be optionally absent
auacccaacugaugaggnnnnnnnnccgaaauagaaug

SEQ ID NO: 5005 - RNA, 38 nt, Artificial Sequence
  Description of Artificial Sequence:  Enzymatic Nucleic Acid
  misc_feature (18)..(25): n stands for any nucleotide and can be optionally absent
aauacccacugaugaggnnnnnnnnccgaaaauagaau

SEQ ID NO: 5006 - RNA, 38 nt, Artificial Sequence
  Description of Artificial Sequence:  Enzymatic Nucleic Acid
  misc_feature (18)..(25): n stands for any nucleotide and can be optionally absent
uaauaccccugaugaggnnnnnnnnccgaaaaauagaa

SEQ ID NO: 5007 - RNA, 38 nt, Artificial Sequence
  Description of Artificial Sequence:  Enzymatic Nucleic Acid
  misc_feature (18)..(25): n stands for any nucleotide and can be optionally absent
uauauuaacugaugaggnnnnnnnnccgaaacccaaaa

SEQ ID NO: 5008 - RNA, 38 nt, Artificial Sequence
  Description of Artificial Sequence:  Enzymatic Nucleic Acid
  misc_feature (18)..(25): n stands for any nucleotide and can be optionally absent
uauauauucugaugaggnnnnnnnnccgaaauacccaa

SEQ ID NO: 5009 - RNA, 38 nt, Artificial Sequence
  Description of Artificial Sequence:  Enzymatic Nucleic Acid
  misc_feature (18)..(25): n stands for any nucleotide and can be optionally absent
cuauauaucugaugaggnnnnnnnnccgaaaauaccca

SEQ ID NO: 5010 - RNA, 38 nt, Artificial Sequence
  Description of Artificial Sequence:  Enzymatic Nucleic Acid
  misc_feature (18)..(25): n stands for any nucleotide and can be optionally absent
ggacuauacugaugaggnnnnnnnnccgaaauuaauac

SEQ ID NO: 5011 - RNA, 38 nt, Artificial Sequence
  Description of Artificial Sequence:  Enzymatic Nucleic Acid
  misc_feature (18)..(25): n stands for any nucleotide and can be optionally absent
cuggacuacugaugaggnnnnnnnnccgaaauauuaau

SEQ ID NO: 5012 - RNA, 38 nt, Artificial Sequence
  Description of Artificial Sequence:  Enzymatic Nucleic Acid
  misc_feature (18)..(25): n stands for any nucleotide and can be optionally absent
gucuggaccugaugaggnnnnnnnnccgaaauauauua

SEQ ID NO: 5013 - RNA, 38 nt, Artificial Sequence
  Description of Artificial Sequence:  Enzymatic Nucleic Acid
  misc_feature (18)..(25): n stands for any nucleotide and can be optionally absent
agugucugcugaugaggnnnnnnnnccgaaacuauaua

SEQ ID NO: 5014 - RNA, 38 nt, Artificial Sequence
  Description of Artificial Sequence:  Enzymatic Nucleic Acid
  misc_feature (18)..(25): n stands for any nucleotide and can be optionally absent
auugaguucugaugaggnnnnnnnnccgaaagugucug

SEQ ID NO: 5015 - RNA, 38 nt, Artificial Sequence
  Description of Artificial Sequence:  Enzymatic Nucleic Acid
  misc_feature (18)..(25): n stands for any nucleotide and can be optionally absent
aauugagucugaugaggnnnnnnnnccgaaaagugucu

SEQ ID NO: 5016 - RNA, 38 nt, Artificial Sequence
  Description of Artificial Sequence:  Enzymatic Nucleic Acid
  misc_feature (18)..(25): n stands for any nucleotide and can be optionally absent
aagaaauucugaugaggnnnnnnnnccgaaaguuaagu

SEQ ID NO: 5017 - RNA, 38 nt, Artificial Sequence
  Description of Artificial Sequence:  Enzymatic Nucleic Acid
  misc_feature (18)..(25): n stands for any nucleotide and can be optionally absent
uaccaagacugaugaggnnnnnnnnccgaaauugaguu

SEQ ID NO: 5018 - RNA, 38 nt, Artificial Sequence
  Description of Artificial Sequence:  Enzymatic Nucleic Acid
  misc_feature (18)..(25): n stands for any nucleotide and can be optionally absent
auaccaagcugaugaggnnnnnnnnccgaaaauugagu

SEQ ID NO: 5019 - RNA, 38 nt, Artificial Sequence
  Description of Artificial Sequence:  Enzymatic Nucleic Acid
  misc_feature (18)..(25): n stands for any nucleotide and can be optionally absent
aauaccaacugaugaggnnnnnnnnccgaaaaauugag

SEQ ID NO: 5020 - RNA, 38 nt, Artificial Sequence
  Description of Artificial Sequence:  Enzymatic Nucleic Acid
  misc_feature (18)..(25): n stands for any nucleotide and can be optionally absent
auaauacccugaugaggnnnnnnnnccgaaagaaauug

SEQ ID NO: 5021 - RNA, 38 nt, Artificial Sequence
  Description of Artificial Sequence:  Enzymatic Nucleic Acid
  misc_feature (18)..(25): n stands for any nucleotide and can be optionally absent
cagaauaacugaugaggnnnnnnnnccgaaaccaagaa

SEQ ID NO: 5022 - RNA, 38 nt, Artificial Sequence
  Description of Artificial Sequence:  Enzymatic Nucleic Acid
  misc_feature (18)..(25): n stands for any nucleotide and can be optionally absent
aacagaaucugaugaggnnnnnnnnccgaaauaccaag

SEQ ID NO: 5023 - RNA, 38 nt, Artificial Sequence
  Description of Artificial Sequence:  Enzymatic Nucleic Acid
  misc_feature (18)..(25): n stands for any nucleotide and can be optionally absent
aaacagaacugaugaggnnnnnnnnccgaaaauaccaa

SEQ ID NO: 5024 - RNA, 38 nt, Artificial Sequence
  Description of Artificial Sequence:  Enzymatic Nucleic Acid
  misc_feature (18)..(25): n stands for any nucleotide and can be optionally absent
caaaacagcugaugaggnnnnnnnnccgaaauaauacc

SEQ ID NO: 5025 - RNA, 38 nt, Artificial Sequence
  Description of Artificial Sequence:  Enzymatic Nucleic Acid
  misc_feature (18)..(25): n stands for any nucleotide and can be optionally absent
gcaaaacacugaugaggnnnnnnnnccgaaaauaauac

SEQ ID NO: 5026 - RNA, 38 nt, Artificial Sequence
  Description of Artificial Sequence:  Enzymatic Nucleic Acid
  misc_feature (18)..(25): n stands for any nucleotide and can be optionally absent
cugugcaacugaugaggnnnnnnnnccgaaacagaaua

SEQ ID NO: 5027 - RNA, 38 nt, Artificial Sequence
  Description of Artificial Sequence:  Enzymatic Nucleic Acid
  misc_feature (18)..(25): n stands for any nucleotide and can be optionally absent
acugugcacugaugaggnnnnnnnnccgaaaacagaau

SEQ ID NO: 5028 - RNA, 38 nt, Artificial Sequence
  Description of Artificial Sequence:  Enzymatic Nucleic Acid
  misc_feature (18)..(25): n stands for any nucleotide and can be optionally absent
aacugugccugaugaggnnnnnnnnccgaaaaacagaa

SEQ ID NO: 5029 - RNA, 38 nt, Artificial Sequence
  Description of Artificial Sequence:  Enzymatic Nucleic Acid
  misc_feature (18)..(25): n stands for any nucleotide and can be optionally absent
ucacaacucugaugaggnnnnnnnnccgaaacugugca

SEQ ID NO: 5030 - RNA, 38 nt, Artificial Sequence
  Description of Artificial Sequence:  Enzymatic Nucleic Acid
  misc_feature (18)..(25): n stands for any nucleotide and can be optionally absent
uucacaaccugaugaggnnnnnnnnccgaaaacugugc

SEQ ID NO: 5031 - RNA, 38 nt, Artificial Sequence
  Description of Artificial Sequence:  Enzymatic Nucleic Acid
  misc_feature (18)..(25): n stands for any nucleotide and can be optionally absent
ucuuucaccugaugaggnnnnnnnnccgaaacuaacug

SEQ ID NO: 5032 - RNA, 38 nt, Artificial Sequence
  Description of Artificial Sequence:  Enzymatic Nucleic Acid
  misc_feature (18)..(25): n stands for any nucleotide and can be optionally absent
cuccucagcugaugaggnnnnnnnnccgaaacugcauu

SEQ ID NO: 5033 - RNA, 38 nt, Artificial Sequence
  Description of Artificial Sequence:  Enzymatic Nucleic Acid
  misc_feature (18)..(25): n stands for any nucleotide and can be optionally absent
auggagaacugaugaggnnnnnnnnccgaaacucuccu

SEQ ID NO: 5034 - RNA, 38 nt, Artificial Sequence
  Description of Artificial Sequence:  Enzymatic Nucleic Acid
  misc_feature (18)..(25): n stands for any nucleotide and can be optionally absent
uauggagacugaugaggnnnnnnnnccgaaaacucucc

SEQ ID NO: 5035 - RNA, 38 nt, Artificial Sequence
  Description of Artificial Sequence:  Enzymatic Nucleic Acid
  misc_feature (18)..(25): n stands for any nucleotide and can be optionally absent
auauggagcugaugaggnnnnnnnnccgaaaaacucuc

SEQ ID NO: 5036 - RNA, 38 nt, Artificial Sequence
  Description of Artificial Sequence:  Enzymatic Nucleic Acid
  misc_feature (18)..(25): n stands for any nucleotide and can be optionally absent
gauauggacugaugaggnnnnnnnnccgaaaaaacucu

SEQ ID NO: 5037 - RNA, 38 nt, Artificial Sequence
  Description of Artificial Sequence:  Enzymatic Nucleic Acid
  misc_feature (18)..(25): n stands for any nucleotide and can be optionally absent
uugauaugcugaugaggnnnnnnnnccgaaagaaaacu

SEQ ID NO: 5038 - RNA, 38 nt, Artificial Sequence
  Description of Artificial Sequence:  Enzymatic Nucleic Acid
  misc_feature (18)..(25): n stands for any nucleotide and can be optionally absent
cguuuugacugaugaggnnnnnnnnccgaaauggagaa

SEQ ID NO: 5039 - RNA, 38 nt, Artificial Sequence
  Description of Artificial Sequence:  Enzymatic Nucleic Acid
  misc_feature (18)..(25): n stands for any nucleotide and can be optionally absent
cucguuuucugaugaggnnnnnnnnccgaaauauggag

SEQ ID NO: 5040 - RNA, 38 nt, Artificial Sequence
  Description of Artificial Sequence:  Enzymatic Nucleic Acid
  misc_feature (18)..(25): n stands for any nucleotide and can be optionally absent
accuuauucugaugaggnnnnnnnnccgaaaccuuuuu

SEQ ID NO: 5041 - RNA, 38 nt, Artificial Sequence
  Description of Artificial Sequence:  Enzymatic Nucleic Acid
  misc_feature (18)..(25): n stands for any nucleotide and can be optionally absent
cuugaccucugaugaggnnnnnnnnccgaaauugaccu

SEQ ID NO: 5042 - RNA, 38 nt, Artificial Sequence
  Description of Artificial Sequence:  Enzymatic Nucleic Acid
  misc_feature (18)..(25): n stands for any nucleotide and can be optionally absent
cuucccuucugaugaggnnnnnnnnccgaaaccuuauu

SEQ ID NO: 5043 - RNA, 38 nt, Artificial Sequence
  Description of Artificial Sequence:  Enzymatic Nucleic Acid
  misc_feature (18)..(25): n stands for any nucleotide and can be optionally absent
gguauagacugaugaggnnnnnnnnccgaaacgggguc

SEQ ID NO: 5044 - RNA, 38 nt, Artificial Sequence
  Description of Artificial Sequence:  Enzymatic Nucleic Acid
  misc_feature (18)..(25): n stands for any nucleotide and can be optionally absent
uugguauacugaugaggnnnnnnnnccgaaagacgggg

SEQ ID NO: 5045 - RNA, 38 nt, Artificial Sequence
  Description of Artificial Sequence:  Enzymatic Nucleic Acid
  misc_feature (18)..(25): n stands for any nucleotide and can be optionally absent
gguugguacugaugaggnnnnnnnnccgaaagagacgg

SEQ ID NO: 5046 - RNA, 38 nt, Artificial Sequence
  Description of Artificial Sequence:  Enzymatic Nucleic Acid
  misc_feature (18)..(25): n stands for any nucleotide and can be optionally absent
uugguuggcugaugaggnnnnnnnnccgaaauagagac

SEQ ID NO: 5047 - RNA, 38 nt, Artificial Sequence
  Description of Artificial Sequence:  Enzymatic Nucleic Acid
  misc_feature (18)..(25): n stands for any nucleotide and can be optionally absent
uguuggugcugaugaggnnnnnnnnccgaaauugguuu

SEQ ID NO: 5048 - RNA, 38 nt, Artificial Sequence
  Description of Artificial Sequence:  Enzymatic Nucleic Acid
  misc_feature (18)..(25): n stands for any nucleotide and can be optionally absent
guguuggucugaugaggnnnnnnnnccgaaaauugguu

SEQ ID NO: 5049 - RNA, 38 nt, Artificial Sequence
  Description of Artificial Sequence:  Enzymatic Nucleic Acid
  misc_feature (18)..(25): n stands for any nucleotide and can be optionally absent
uggguccccugaugaggnnnnnnnnccgaaacuguguu

SEQ ID NO: 5050 - RNA, 38 nt, Artificial Sequence
  Description of Artificial Sequence:  Enzymatic Nucleic Acid
  misc_feature (18)..(25): n stands for any nucleotide and can be optionally absent
acgugacucugaugaggnnnnnnnnccgaaacuuccug

SEQ ID NO: 5051 - RNA, 38 nt, Artificial Sequence
  Description of Artificial Sequence:  Enzymatic Nucleic Acid
  misc_feature (18)..(25): n stands for any nucleotide and can be optionally absent
ggaaacgucugaugaggnnnnnnnnccgaaacugacuu

SEQ ID NO: 5052 - RNA, 38 nt, Artificial Sequence
  Description of Artificial Sequence:  Enzymatic Nucleic Acid
  misc_feature (18)..(25): n stands for any nucleotide and can be optionally absent
gaaaaggacugaugaggnnnnnnnnccgaaacgugacu

SEQ ID NO: 5053 - RNA, 38 nt, Artificial Sequence
  Description of Artificial Sequence:  Enzymatic Nucleic Acid
  misc_feature (18)..(25): n stands for any nucleotide and can be optionally absent
ugaaaaggcugaugaggnnnnnnnnccgaaaacgugac

SEQ ID NO: 5054 - RNA, 38 nt, Artificial Sequence
  Description of Artificial Sequence:  Enzymatic Nucleic Acid
  misc_feature (18)..(25): n stands for any nucleotide and can be optionally absent
augaaaagcugaugaggnnnnnnnnccgaaaaacguga

SEQ ID NO: 5055 - RNA, 38 nt, Artificial Sequence
  Description of Artificial Sequence:  Enzymatic Nucleic Acid
  misc_feature (18)..(25): n stands for any nucleotide and can be optionally absent
uaaaugaacugaugaggnnnnnnnnccgaaaggaaacg

SEQ ID NO: 5056 - RNA, 38 nt, Artificial Sequence
  Description of Artificial Sequence:  Enzymatic Nucleic Acid
  misc_feature (18)..(25): n stands for any nucleotide and can be optionally absent
uuaaaugacugaugaggnnnnnnnnccgaaaaggaaac

SEQ ID NO: 5057 - RNA, 38 nt, Artificial Sequence
  Description of Artificial Sequence:  Enzymatic Nucleic Acid
  misc_feature (18)..(25): n stands for any nucleotide and can be optionally absent
auuaaaugcugaugaggnnnnnnnnccgaaaaaggaaa

SEQ ID NO: 5058 - RNA, 38 nt, Artificial Sequence
  Description of Artificial Sequence:  Enzymatic Nucleic Acid
  misc_feature (18)..(25): n stands for any nucleotide and can be optionally absent
cauuaaaucugaugaggnnnnnnnnccgaaaaaaggaa

SEQ ID NO: 5059 - RNA, 38 nt, Artificial Sequence
  Description of Artificial Sequence:  Enzymatic Nucleic Acid
  misc_feature (18)..(25): n stands for any nucleotide and can be optionally absent
ccccauuacugaugaggnnnnnnnnccgaaaugaaaag

SEQ ID NO: 5060 - RNA, 38 nt, Artificial Sequence
  Description of Artificial Sequence:  Enzymatic Nucleic Acid
  misc_feature (18)..(25): n stands for any nucleotide and can be optionally absent
uccccauucugaugaggnnnnnnnnccgaaaaugaaaa

SEQ ID NO: 5061 - RNA, 38 nt, Artificial Sequence
  Description of Artificial Sequence:  Enzymatic Nucleic Acid
  misc_feature (18)..(25): n stands for any nucleotide and can be optionally absent
auccccaucugaugaggnnnnnnnnccgaaaaaugaaa

SEQ ID NO: 5062 - RNA, 38 nt, Artificial Sequence
  Description of Artificial Sequence:  Enzymatic Nucleic Acid
  misc_feature (18)..(25): n stands for any nucleotide and can be optionally absent
gauaguggcugaugaggnnnnnnnnccgaaauccccau

SEQ ID NO: 5063 - RNA, 38 nt, Artificial Sequence
  Description of Artificial Sequence:  Enzymatic Nucleic Acid
  misc_feature (18)..(25): n stands for any nucleotide and can be optionally absent
agauagugcugaugaggnnnnnnnnccgaaaaucccca

SEQ ID NO: 5064 - RNA, 38 nt, Artificial Sequence
  Description of Artificial Sequence:  Enzymatic Nucleic Acid
  misc_feature (18)..(25): n stands for any nucleotide and can be optionally absent
gugugagacugaugaggnnnnnnnnccgaaaguggaau

SEQ ID NO: 5065 - RNA, 38 nt, Artificial Sequence
  Description of Artificial Sequence:  Enzymatic Nucleic Acid
  misc_feature (18)..(25): n stands for any nucleotide and can be optionally absent
uagugugacugaugaggnnnnnnnnccgaaauagugga

SEQ ID NO: 5066 - RNA, 38 nt, Artificial Sequence
  Description of Artificial Sequence:  Enzymatic Nucleic Acid
  misc_feature (18)..(25): n stands for any nucleotide and can be optionally absent
auuagugucugaugaggnnnnnnnnccgaaagauagug

SEQ ID NO: 5067 - RNA, 38 nt, Artificial Sequence
  Description of Artificial Sequence:  Enzymatic Nucleic Acid
  misc_feature (18)..(25): n stands for any nucleotide and can be optionally absent
uuucagaucugaugaggnnnnnnnnccgaaagugugag

SEQ ID NO: 5068 - RNA, 38 nt, Artificial Sequence
  Description of Artificial Sequence:  Enzymatic Nucleic Acid
  misc_feature (18)..(25): n stands for any nucleotide and can be optionally absent
uccuuucacugaugaggnnnnnnnnccgaaauuagugu

SEQ ID NO: 5069 - RNA, 38 nt, Artificial Sequence
  Description of Artificial Sequence:  Enzymatic Nucleic Acid
  misc_feature (18)..(25): n stands for any nucleotide and can be optionally absent
cgccagcucugaugaggnnnnnnnnccgaaaugcucuu

SEQ ID NO: 5070 - RNA, 38 nt, Artificial Sequence
  Description of Artificial Sequence:  Enzymatic Nucleic Acid
  misc_feature (18)..(25): n stands for any nucleotide and can be optionally absent
gcgccagccugaugaggnnnnnnnnccgaaaaugcucu

SEQ ID NO: 5071 - RNA, 38 nt, Artificial Sequence
  Description of Artificial Sequence:  Enzymatic Nucleic Acid
  misc_feature (18)..(25): n stands for any nucleotide and can be optionally absent
gugcuuaacugaugaggnnnnnnnnccgaaaugcgcca

SEQ ID NO: 5072 - RNA, 38 nt, Artificial Sequence
  Description of Artificial Sequence:  Enzymatic Nucleic Acid
  misc_feature (18)..(25): n stands for any nucleotide and can be optionally absent
aagugcuucugaugaggnnnnnnnnccgaaauaugcgc

SEQ ID NO: 5073 - RNA, 38 nt, Artificial Sequence
  Description of Artificial Sequence:  Enzymatic Nucleic Acid
  misc_feature (18)..(25): n stands for any nucleotide and can be optionally absent
aaagugcucugaugaggnnnnnnnnccgaaaauaugcg

SEQ ID NO: 5074 - RNA, 38 nt, Artificial Sequence
  Description of Artificial Sequence:  Enzymatic Nucleic Acid
  misc_feature (18)..(25): n stands for any nucleotide and can be optionally absent
ggagcuuacugaugaggnnnnnnnnccgaaagugcuua

SEQ ID NO: 5075 - RNA, 38 nt, Artificial Sequence
  Description of Artificial Sequence:  Enzymatic Nucleic Acid
  misc_feature (18)..(25): n stands for any nucleotide and can be optionally absent
aggagcuucugaugaggnnnnnnnnccgaaaagugcuu

SEQ ID NO: 5076 - RNA, 38 nt, Artificial Sequence
  Description of Artificial Sequence:  Enzymatic Nucleic Acid
  misc_feature (18)..(25): n stands for any nucleotide and can be optionally absent
aaggagcucugaugaggnnnnnnnnccgaaaaagugcu

SEQ ID NO: 5077 - RNA, 38 nt, Artificial Sequence
  Description of Artificial Sequence:  Enzymatic Nucleic Acid
  misc_feature (18)..(25): n stands for any nucleotide and can be optionally absent
uacucaagcugaugaggnnnnnnnnccgaaagcuuaaa

SEQ ID NO: 5078 - RNA, 38 nt, Artificial Sequence
  Description of Artificial Sequence:  Enzymatic Nucleic Acid
  misc_feature (18)..(25): n stands for any nucleotide and can be optionally absent
uuuuacuccugaugaggnnnnnnnnccgaaaggagcuu

SEQ ID NO: 5079 - RNA, 38 nt, Artificial Sequence
  Description of Artificial Sequence:  Enzymatic Nucleic Acid
  misc_feature (18)..(25): n stands for any nucleotide and can be optionally absent
caccuuuucugaugaggnnnnnnnnccgaaacucaagg

SEQ ID NO: 5080 - RNA, 38 nt, Artificial Sequence
  Description of Artificial Sequence:  Enzymatic Nucleic Acid
  misc_feature (18)..(25): n stands for any nucleotide and can be optionally absent
aaauuacacugaugaggnnnnnnnnccgaaaccaccuu

SEQ ID NO: 5081 - RNA, 38 nt, Artificial Sequence
  Description of Artificial Sequence:  Enzymatic Nucleic Acid
  misc_feature (18)..(25): n stands for any nucleotide and can be optionally absent
gcauaaaucugaugaggnnnnnnnnccgaaacauacca

SEQ ID NO: 5082 - RNA, 38 nt, Artificial Sequence
  Description of Artificial Sequence:  Enzymatic Nucleic Acid
  misc_feature (18)..(25): n stands for any nucleotide and can be optionally absent
cuugcauacugaugaggnnnnnnnnccgaaauuacaua

SEQ ID NO: 5083 - RNA, 38 nt, Artificial Sequence
  Description of Artificial Sequence:  Enzymatic Nucleic Acid
  misc_feature (18)..(25): n stands for any nucleotide and can be optionally absent
ccuugcaucugaugaggnnnnnnnnccgaaaauuacau

SEQ ID NO: 5084 - RNA, 38 nt, Artificial Sequence
  Description of Artificial Sequence:  Enzymatic Nucleic Acid
  misc_feature (18)..(25): n stands for any nucleotide and can be optionally absent
accuugcacugaugaggnnnnnnnnccgaaaaauuaca

SEQ ID NO: 5085 - RNA, 38 nt, Artificial Sequence
  Description of Artificial Sequence:  Enzymatic Nucleic Acid
  misc_feature (18)..(25): n stands for any nucleotide and can be optionally absent
uggagaaacugaugaggnnnnnnnnccgaaaccuugca

SEQ ID NO: 5086 - RNA, 38 nt, Artificial Sequence
  Description of Artificial Sequence:  Enzymatic Nucleic Acid
  misc_feature (18)..(25): n stands for any nucleotide and can be optionally absent
acuggagacugaugaggnnnnnnnnccgaaauaccuug

SEQ ID NO: 5087 - RNA, 38 nt, Artificial Sequence
  Description of Artificial Sequence:  Enzymatic Nucleic Acid
  misc_feature (18)..(25): n stands for any nucleotide and can be optionally absent
aacuggagcugaugaggnnnnnnnnccgaaaauaccuu

SEQ ID NO: 5088 - RNA, 38 nt, Artificial Sequence
  Description of Artificial Sequence:  Enzymatic Nucleic Acid
  misc_feature (18)..(25): n stands for any nucleotide and can be optionally absent
caacuggacugaugaggnnnnnnnnccgaaaaauaccu

SEQ ID NO: 5089 - RNA, 38 nt, Artificial Sequence
  Description of Artificial Sequence:  Enzymatic Nucleic Acid
  misc_feature (18)..(25): n stands for any nucleotide and can be optionally absent
cccaacugcugaugaggnnnnnnnnccgaaagaaauac

SEQ ID NO: 5090 - RNA, 38 nt, Artificial Sequence
  Description of Artificial Sequence:  Enzymatic Nucleic Acid
  misc_feature (18)..(25): n stands for any nucleotide and can be optionally absent
ugaguccccugaugaggnnnnnnnnccgaaacuggaga

SEQ ID NO: 5091 - RNA, 38 nt, Artificial Sequence
  Description of Artificial Sequence:  Enzymatic Nucleic Acid
  misc_feature (18)..(25): n stands for any nucleotide and can be optionally absent
aauauccucugaugaggnnnnnnnnccgaaagucccaa

SEQ ID NO: 5092 - RNA, 38 nt, Artificial Sequence
  Description of Artificial Sequence:  Enzymatic Nucleic Acid
  misc_feature (18)..(25): n stands for any nucleotide and can be optionally absent
uuaacuaacugaugaggnnnnnnnnccgaaauccugag

SEQ ID NO: 5093 - RNA, 38 nt, Artificial Sequence
  Description of Artificial Sequence:  Enzymatic Nucleic Acid
  misc_feature (18)..(25): n stands for any nucleotide and can be optionally absent
cauuaacucugaugaggnnnnnnnnccgaaauauccug

SEQ ID NO: 5094 - RNA, 38 nt, Artificial Sequence
  Description of Artificial Sequence:  Enzymatic Nucleic Acid
  misc_feature (18)..(25): n stands for any nucleotide and can be optionally absent
ucauuaaccugaugaggnnnnnnnnccgaaaauauccu

SEQ ID NO: 5095 - RNA, 38 nt, Artificial Sequence
  Description of Artificial Sequence:  Enzymatic Nucleic Acid
  misc_feature (18)..(25): n stands for any nucleotide and can be optionally absent
ggcucauucugaugaggnnnnnnnnccgaaacuaauau

SEQ ID NO: 5096 - RNA, 38 nt, Artificial Sequence
  Description of Artificial Sequence:  Enzymatic Nucleic Acid
  misc_feature (18)..(25): n stands for any nucleotide and can be optionally absent
uggcucaucugaugaggnnnnnnnnccgaaaacuaaua

SEQ ID NO: 5097 - RNA, 38 nt, Artificial Sequence
  Description of Artificial Sequence:  Enzymatic Nucleic Acid
  misc_feature (18)..(25): n stands for any nucleotide and can be optionally absent
cuucuagucugaugaggnnnnnnnnccgaaauggcuca

SEQ ID NO: 5098 - RNA, 38 nt, Artificial Sequence
  Description of Artificial Sequence:  Enzymatic Nucleic Acid
  misc_feature (18)..(25): n stands for any nucleotide and can be optionally absent
uuuucuuccugaugaggnnnnnnnnccgaaagugaugg

SEQ ID NO: 5099 - RNA, 38 nt, Artificial Sequence
  Description of Artificial Sequence:  Enzymatic Nucleic Acid
  misc_feature (18)..(25): n stands for any nucleotide and can be optionally absent
caguugaacugaugaggnnnnnnnnccgaaaugggcuu

SEQ ID NO: 5100 - RNA, 38 nt, Artificial Sequence
  Description of Artificial Sequence:  Enzymatic Nucleic Acid
  misc_feature (18)..(25): n stands for any nucleotide and can be optionally absent
gcaguugacugaugaggnnnnnnnnccgaaaaugggcu

SEQ ID NO: 5101 - RNA, 38 nt, Artificial Sequence
  Description of Artificial Sequence:  Enzymatic Nucleic Acid
  misc_feature (18)..(25): n stands for any nucleotide and can be optionally absent
agcaguugcugaugaggnnnnnnnnccgaaaaaugggc

SEQ ID NO: 5102 - RNA, 38 nt, Artificial Sequence
  Description of Artificial Sequence:  Enzymatic Nucleic Acid
  misc_feature (18)..(25): n stands for any nucleotide and can be optionally absent
aagcaguucugaugaggnnnnnnnnccgaaaaaauggg

SEQ ID NO: 5103 - RNA, 38 nt, Artificial Sequence
  Description of Artificial Sequence:  Enzymatic Nucleic Acid
  misc_feature (18)..(25): n stands for any nucleotide and can be optionally absent
aaguuucacugaugaggnnnnnnnnccgaaagcaguug

SEQ ID NO: 5104 - RNA, 38 nt, Artificial Sequence
  Description of Artificial Sequence:  Enzymatic Nucleic Acid
  misc_feature (18)..(25): n stands for any nucleotide and can be optionally absent
caaguuuccugaugaggnnnnnnnnccgaaaagcaguu

SEQ ID NO: 5105 - RNA, 38 nt, Artificial Sequence
  Description of Artificial Sequence:  Enzymatic Nucleic Acid
  misc_feature (18)..(25): n stands for any nucleotide and can be optionally absent
ccccaggccugaugaggnnnnnnnnccgaaaguuucaa

SEQ ID NO: 5106 - RNA, 38 nt, Artificial Sequence
  Description of Artificial Sequence:  Enzymatic Nucleic Acid
  misc_feature (18)..(25): n stands for any nucleotide and can be optionally absent
caugcucacugaugaggnnnnnnnnccgaaaccccagg

SEQ ID NO: 5107 - RNA, 38 nt, Artificial Sequence
  Description of Artificial Sequence:  Enzymatic Nucleic Acid
  misc_feature (18)..(25): n stands for any nucleotide and can be optionally absent
ugucuccccugaugaggnnnnnnnnccgaaauucccau

SEQ ID NO: 5108 - RNA, 38 nt, Artificial Sequence
  Description of Artificial Sequence:  Enzymatic Nucleic Acid
  misc_feature (18)..(25): n stands for any nucleotide and can be optionally absent
cccuuucccugaugaggnnnnnnnnccgaaacccuguc

SEQ ID NO: 5109 - RNA, 38 nt, Artificial Sequence
  Description of Artificial Sequence:  Enzymatic Nucleic Acid
  misc_feature (18)..(25): n stands for any nucleotide and can be optionally absent
cugaagagcugaugaggnnnnnnnnccgaaaggcgccc

SEQ ID NO: 5110 - RNA, 38 nt, Artificial Sequence
  Description of Artificial Sequence:  Enzymatic Nucleic Acid
  misc_feature (18)..(25): n stands for any nucleotide and can be optionally absent
acccugaacugaugaggnnnnnnnnccgaaaguaggcg

SEQ ID NO: 5111 - RNA, 38 nt, Artificial Sequence
  Description of Artificial Sequence:  Enzymatic Nucleic Acid
  misc_feature (18)..(25): n stands for any nucleotide and can be optionally absent
agacccugcugaugaggnnnnnnnnccgaaagaguagg

SEQ ID NO: 5112 - RNA, 38 nt, Artificial Sequence
  Description of Artificial Sequence:  Enzymatic Nucleic Acid
  misc_feature (18)..(25): n stands for any nucleotide and can be optionally absent
uagacccucugaugaggnnnnnnnnccgaaaagaguag

SEQ ID NO: 5113 - RNA, 38 nt, Artificial Sequence
  Description of Artificial Sequence:  Enzymatic Nucleic Acid
  misc_feature (18)..(25): n stands for any nucleotide and can be optionally absent
gaucuuuacugaugaggnnnnnnnnccgaaacccugaa

SEQ ID NO: 5114 - RNA, 38 nt, Artificial Sequence
  Description of Artificial Sequence:  Enzymatic Nucleic Acid
  misc_feature (18)..(25): n stands for any nucleotide and can be optionally absent
uugaucuucugaugaggnnnnnnnnccgaaagacccug

SEQ ID NO: 5115 - RNA, 38 nt, Artificial Sequence
  Description of Artificial Sequence:  Enzymatic Nucleic Acid
  misc_feature (18)..(25): n stands for any nucleotide and can be optionally absent
gcccacuucugaugaggnnnnnnnnccgaaaucuuuag

SEQ ID NO: 5116 - RNA, 38 nt, Artificial Sequence
  Description of Artificial Sequence:  Enzymatic Nucleic Acid
  misc_feature (18)..(25): n stands for any nucleotide and can be optionally absent
agcgaucccugaugaggnnnnnnnnccgaaaggcccac

SEQ ID NO: 5117 - RNA, 38 nt, Artificial Sequence
  Description of Artificial Sequence:  Enzymatic Nucleic Acid
  misc_feature (18)..(25): n stands for any nucleotide and can be optionally absent
agcuuagccugaugaggnnnnnnnnccgaaauccaagg

SEQ ID NO: 5118 - RNA, 38 nt, Artificial Sequence
  Description of Artificial Sequence:  Enzymatic Nucleic Acid
  misc_feature (18)..(25): n stands for any nucleotide and can be optionally absent
agccagcucugaugaggnnnnnnnnccgaaagcgaucc

SEQ ID NO: 5119 - RNA, 38 nt, Artificial Sequence
  Description of Artificial Sequence:  Enzymatic Nucleic Acid
  misc_feature (18)..(25): n stands for any nucleotide and can be optionally absent
aucaaacacugaugaggnnnnnnnnccgaaagccagcu

SEQ ID NO: 5120 - RNA, 38 nt, Artificial Sequence
  Description of Artificial Sequence:  Enzymatic Nucleic Acid
  misc_feature (18)..(25): n stands for any nucleotide and can be optionally absent
uagcaucacugaugaggnnnnnnnnccgaaacagagcc

SEQ ID NO: 5121 - RNA, 38 nt, Artificial Sequence
  Description of Artificial Sequence:  Enzymatic Nucleic Acid
  misc_feature (18)..(25): n stands for any nucleotide and can be optionally absent
auagcauccugaugaggnnnnnnnnccgaaaacagagc

SEQ ID NO: 5122 - RNA, 38 nt, Artificial Sequence
  Description of Artificial Sequence:  Enzymatic Nucleic Acid
  misc_feature (18)..(25): n stands for any nucleotide and can be optionally absent
ugcauaaacugaugaggnnnnnnnnccgaaagcaucaa

SEQ ID NO: 5123 - RNA, 38 nt, Artificial Sequence
  Description of Artificial Sequence:  Enzymatic Nucleic Acid
  misc_feature (18)..(25): n stands for any nucleotide and can be optionally absent
cuugcauacugaugaggnnnnnnnnccgaaauagcauc

SEQ ID NO: 5124 - RNA, 38 nt, Artificial Sequence
  Description of Artificial Sequence:  Enzymatic Nucleic Acid
  misc_feature (18)..(25): n stands for any nucleotide and can be optionally absent
acuugcaucugaugaggnnnnnnnnccgaaaauagcau

SEQ ID NO: 5125 - RNA, 38 nt, Artificial Sequence
  Description of Artificial Sequence:  Enzymatic Nucleic Acid
  misc_feature (18)..(25): n stands for any nucleotide and can be optionally absent
aacuugcacugaugaggnnnnnnnnccgaaaaauagca

SEQ ID NO: 5126 - RNA, 38 nt, Artificial Sequence
  Description of Artificial Sequence:  Enzymatic Nucleic Acid
  misc_feature (18)..(25): n stands for any nucleotide and can be optionally absent
uagacccucugaugaggnnnnnnnnccgaaacuugcau

SEQ ID NO: 5127 - RNA, 38 nt, Artificial Sequence
  Description of Artificial Sequence:  Enzymatic Nucleic Acid
  misc_feature (18)..(25): n stands for any nucleotide and can be optionally absent
auagaccccugaugaggnnnnnnnnccgaaaacuugca

SEQ ID NO: 5128 - RNA, 38 nt, Artificial Sequence
  Description of Artificial Sequence:  Enzymatic Nucleic Acid
  misc_feature (18)..(25): n stands for any nucleotide and can be optionally absent
aauacauacugaugaggnnnnnnnnccgaaacccuaac

SEQ ID NO: 5129 - RNA, 38 nt, Artificial Sequence
  Description of Artificial Sequence:  Enzymatic Nucleic Acid
  misc_feature (18)..(25): n stands for any nucleotide and can be optionally absent
uaaauacacugaugaggnnnnnnnnccgaaagacccua

SEQ ID NO: 5130 - RNA, 38 nt, Artificial Sequence
  Description of Artificial Sequence:  Enzymatic Nucleic Acid
  misc_feature (18)..(25): n stands for any nucleotide and can be optionally absent
auccuaaacugaugaggnnnnnnnnccgaaacauagac

SEQ ID NO: 5131 - RNA, 38 nt, Artificial Sequence
  Description of Artificial Sequence:  Enzymatic Nucleic Acid
  misc_feature (18)..(25): n stands for any nucleotide and can be optionally absent
gcauccuacugaugaggnnnnnnnnccgaaauacauag

SEQ ID NO: 5132 - RNA, 38 nt, Artificial Sequence
  Description of Artificial Sequence:  Enzymatic Nucleic Acid
  misc_feature (18)..(25): n stands for any nucleotide and can be optionally absent
cgcauccucugaugaggnnnnnnnnccgaaaauacaua

SEQ ID NO: 5133 - RNA, 38 nt, Artificial Sequence
  Description of Artificial Sequence:  Enzymatic Nucleic Acid
  misc_feature (18)..(25): n stands for any nucleotide and can be optionally absent
gcgcaucccugaugaggnnnnnnnnccgaaaaauacau

SEQ ID NO: 5134 - RNA, 38 nt, Artificial Sequence
  Description of Artificial Sequence:  Enzymatic Nucleic Acid
  misc_feature (18)..(25): n stands for any nucleotide and can be optionally absent
cugaagagcugaugaggnnnnnnnnccgaaaggcgcau

SEQ ID NO: 5135 - RNA, 38 nt, Artificial Sequence
  Description of Artificial Sequence:  Enzymatic Nucleic Acid
  misc_feature (18)..(25): n stands for any nucleotide and can be optionally absent
acauccuacugaugaggnnnnnnnnccgaaauacauag

SEQ ID NO: 5136 - RNA, 38 nt, Artificial Sequence
  Description of Artificial Sequence:  Enzymatic Nucleic Acid
  misc_feature (18)..(25): n stands for any nucleotide and can be optionally absent
gacauccucugaugaggnnnnnnnnccgaaaauacaua

SEQ ID NO: 5137 - RNA, 38 nt, Artificial Sequence
  Description of Artificial Sequence:  Enzymatic Nucleic Acid
  misc_feature (18)..(25): n stands for any nucleotide and can be optionally absent
agacaucccugaugaggnnnnnnnnccgaaaaauacau

SEQ ID NO: 5138 - RNA, 38 nt, Artificial Sequence
  Description of Artificial Sequence:  Enzymatic Nucleic Acid
  misc_feature (18)..(25): n stands for any nucleotide and can be optionally absent
aaggugcacugaugaggnnnnnnnnccgaaacauccua

SEQ ID NO: 5139 - RNA, 38 nt, Artificial Sequence
  Description of Artificial Sequence:  Enzymatic Nucleic Acid
  misc_feature (18)..(25): n stands for any nucleotide and can be optionally absent
ggcugcagcugaugaggnnnnnnnnccgaaaggugcag

SEQ ID NO: 5140 - RNA, 38 nt, Artificial Sequence
  Description of Artificial Sequence:  Enzymatic Nucleic Acid
  misc_feature (18)..(25): n stands for any nucleotide and can be optionally absent
uggcugcacugaugaggnnnnnnnnccgaaaaggugca

SEQ ID NO: 5141 - RNA, 38 nt, Artificial Sequence
  Description of Artificial Sequence:  Enzymatic Nucleic Acid
  misc_feature (18)..(25): n stands for any nucleotide and can be optionally absent
cagcuucucugaugaggnnnnnnnnccgaaacuggcug

SEQ ID NO: 5142 - RNA, 38 nt, Artificial Sequence
  Description of Artificial Sequence:  Enzymatic Nucleic Acid
  misc_feature (18)..(25): n stands for any nucleotide and can be optionally absent
gaagcagccugaugaggnnnnnnnnccgaaauccacug

SEQ ID NO: 5143 - RNA, 38 nt, Artificial Sequence
  Description of Artificial Sequence:  Enzymatic Nucleic Acid
  misc_feature (18)..(25): n stands for any nucleotide and can be optionally absent
uccccaagcugaugaggnnnnnnnnccgaaagcagcaa

SEQ ID NO: 5144 - RNA, 38 nt, Artificial Sequence
  Description of Artificial Sequence:  Enzymatic Nucleic Acid
  misc_feature (18)..(25): n stands for any nucleotide and can be optionally absent
cuccccaacugaugaggnnnnnnnnccgaaaagcagca

SEQ ID NO: 5145 - RNA, 38 nt, Artificial Sequence
  Description of Artificial Sequence:  Enzymatic Nucleic Acid
  misc_feature (18)..(25): n stands for any nucleotide and can be optionally absent
uucucccccugaugaggnnnnnnnnccgaaagaagcag

SEQ ID NO: 5146 - RNA, 38 nt, Artificial Sequence
  Description of Artificial Sequence:  Enzymatic Nucleic Acid
  misc_feature (18)..(25): n stands for any nucleotide and can be optionally absent
aggaagcacugaugaggnnnnnnnnccgaaacucuucu

SEQ ID NO: 5147 - RNA, 38 nt, Artificial Sequence
  Description of Artificial Sequence:  Enzymatic Nucleic Acid
  misc_feature (18)..(25): n stands for any nucleotide and can be optionally absent
auaaaaggcugaugaggnnnnnnnnccgaaagcauacu

SEQ ID NO: 5148 - RNA, 38 nt, Artificial Sequence
  Description of Artificial Sequence:  Enzymatic Nucleic Acid
  misc_feature (18)..(25): n stands for any nucleotide and can be optionally absent
gauaaaagcugaugaggnnnnnnnnccgaaaagcauac

SEQ ID NO: 5149 - RNA, 38 nt, Artificial Sequence
  Description of Artificial Sequence:  Enzymatic Nucleic Acid
  misc_feature (18)..(25): n stands for any nucleotide and can be optionally absent
auggauaacugaugaggnnnnnnnnccgaaaggaagca

SEQ ID NO: 5150 - RNA, 38 nt, Artificial Sequence
  Description of Artificial Sequence:  Enzymatic Nucleic Acid
  misc_feature (18)..(25): n stands for any nucleotide and can be optionally absent
cauggauacugaugaggnnnnnnnnccgaaaaggaagc

SEQ ID NO: 5151 - RNA, 38 nt, Artificial Sequence
  Description of Artificial Sequence:  Enzymatic Nucleic Acid
  misc_feature (18)..(25): n stands for any nucleotide and can be optionally absent
acauggaucugaugaggnnnnnnnnccgaaaaaggaag

SEQ ID NO: 5152 - RNA, 38 nt, Artificial Sequence
  Description of Artificial Sequence:  Enzymatic Nucleic Acid
  misc_feature (18)..(25): n stands for any nucleotide and can be optionally absent
uacauggacugaugaggnnnnnnnnccgaaaaaaggaa

SEQ ID NO: 5153 - RNA, 38 nt, Artificial Sequence
  Description of Artificial Sequence:  Enzymatic Nucleic Acid
  misc_feature (18)..(25): n stands for any nucleotide and can be optionally absent
auuacaugcugaugaggnnnnnnnnccgaaauaaaagg

SEQ ID NO: 5154 - RNA, 38 nt, Artificial Sequence
  Description of Artificial Sequence:  Enzymatic Nucleic Acid
  misc_feature (18)..(25): n stands for any nucleotide and can be optionally absent
aguuaaaucugaugaggnnnnnnnnccgaaacauggau

SEQ ID NO: 5155 - RNA, 38 nt, Artificial Sequence
  Description of Artificial Sequence:  Enzymatic Nucleic Acid
  misc_feature (18)..(25): n stands for any nucleotide and can be optionally absent
uacaguuacugaugaggnnnnnnnnccgaaauuacaug

SEQ ID NO: 5156 - RNA, 38 nt, Artificial Sequence
  Description of Artificial Sequence:  Enzymatic Nucleic Acid
  misc_feature (18)..(25): n stands for any nucleotide and can be optionally absent
cuacaguucugaugaggnnnnnnnnccgaaaauuacau

SEQ ID NO: 5157 - RNA, 38 nt, Artificial Sequence
  Description of Artificial Sequence:  Enzymatic Nucleic Acid
  misc_feature (18)..(25): n stands for any nucleotide and can be optionally absent
ucuacagucugaugaggnnnnnnnnccgaaaaauuaca

SEQ ID NO: 5158 - RNA, 38 nt, Artificial Sequence
  Description of Artificial Sequence:  Enzymatic Nucleic Acid
  misc_feature (18)..(25): n stands for any nucleotide and can be optionally absent
ucagguuccugaugaggnnnnnnnnccgaaacaguuaa

SEQ ID NO: 5159 - RNA, 38 nt, Artificial Sequence
  Description of Artificial Sequence:  Enzymatic Nucleic Acid
  misc_feature (18)..(25): n stands for any nucleotide and can be optionally absent
guuacuuacugaugaggnnnnnnnnccgaaagcucagg

SEQ ID NO: 5160 - RNA, 38 nt, Artificial Sequence
  Description of Artificial Sequence:  Enzymatic Nucleic Acid
  misc_feature (18)..(25): n stands for any nucleotide and can be optionally absent
cgguuacucugaugaggnnnnnnnnccgaaagagcuca

SEQ ID NO: 5161 - RNA, 38 nt, Artificial Sequence
  Description of Artificial Sequence:  Enzymatic Nucleic Acid
  misc_feature (18)..(25): n stands for any nucleotide and can be optionally absent
ucuucggucugaugaggnnnnnnnnccgaaacuuagag

SEQ ID NO: 5162 - RNA, 38 nt, Artificial Sequence
  Description of Artificial Sequence:  Enzymatic Nucleic Acid
  misc_feature (18)..(25): n stands for any nucleotide and can be optionally absent
cagaggcacugaugaggnnnnnnnnccgaaacauucuu

SEQ ID NO: 5163 - RNA, 38 nt, Artificial Sequence
  Description of Artificial Sequence:  Enzymatic Nucleic Acid
  misc_feature (18)..(25): n stands for any nucleotide and can be optionally absent
uaagaacacugaugaggnnnnnnnnccgaaaggcauac

SEQ ID NO: 5164 - RNA, 38 nt, Artificial Sequence
  Description of Artificial Sequence:  Enzymatic Nucleic Acid
  misc_feature (18)..(25): n stands for any nucleotide and can be optionally absent
cacauaagcugaugaggnnnnnnnnccgaaacagaggc

SEQ ID NO: 5165 - RNA, 38 nt, Artificial Sequence
  Description of Artificial Sequence:  Enzymatic Nucleic Acid
  misc_feature (18)..(25): n stands for any nucleotide and can be optionally absent
gcacauaacugaugaggnnnnnnnnccgaaaacagagg

SEQ ID NO: 5166 - RNA, 38 nt, Artificial Sequence
  Description of Artificial Sequence:  Enzymatic Nucleic Acid
  misc_feature (18)..(25): n stands for any nucleotide and can be optionally absent
uggcacaucugaugaggnnnnnnnnccgaaagaacaga

SEQ ID NO: 5167 - RNA, 38 nt, Artificial Sequence
  Description of Artificial Sequence:  Enzymatic Nucleic Acid
  misc_feature (18)..(25): n stands for any nucleotide and can be optionally absent
guggcacacugaugaggnnnnnnnnccgaaaagaacag

SEQ ID NO: 5168 - RNA, 38 nt, Artificial Sequence
  Description of Artificial Sequence:  Enzymatic Nucleic Acid
  misc_feature (18)..(25): n stands for any nucleotide and can be optionally absent
uaaacaagcugaugaggnnnnnnnnccgaaauguggca

SEQ ID NO: 5169 - RNA, 38 nt, Artificial Sequence
  Description of Artificial Sequence:  Enzymatic Nucleic Acid
  misc_feature (18)..(25): n stands for any nucleotide and can be optionally absent
cuuuaaaccugaugaggnnnnnnnnccgaaaggaugug

SEQ ID NO: 5170 - RNA, 38 nt, Artificial Sequence
  Description of Artificial Sequence:  Enzymatic Nucleic Acid
  misc_feature (18)..(25): n stands for any nucleotide and can be optionally absent
agccuuuacugaugaggnnnnnnnnccgaaacaaggau

SEQ ID NO: 5171 - RNA, 38 nt, Artificial Sequence
  Description of Artificial Sequence:  Enzymatic Nucleic Acid
  misc_feature (18)..(25): n stands for any nucleotide and can be optionally absent
gagccuuucugaugaggnnnnnnnnccgaaaacaagga

SEQ ID NO: 5172 - RNA, 38 nt, Artificial Sequence
  Description of Artificial Sequence:  Enzymatic Nucleic Acid
  misc_feature (18)..(25): n stands for any nucleotide and can be optionally absent
agagccuucugaugaggnnnnnnnnccgaaaaacaagg

SEQ ID NO: 5173 - RNA, 38 nt, Artificial Sequence
  Description of Artificial Sequence:  Enzymatic Nucleic Acid
  misc_feature (18)..(25): n stands for any nucleotide and can be optionally absent
cauacagacugaugaggnnnnnnnnccgaaagccuuua

SEQ ID NO: 5174 - RNA, 38 nt, Artificial Sequence
  Description of Artificial Sequence:  Enzymatic Nucleic Acid
  misc_feature (18)..(25): n stands for any nucleotide and can be optionally absent
uucauacacugaugaggnnnnnnnnccgaaagagccuu

SEQ ID NO: 5175 - RNA, 38 nt, Artificial Sequence
  Description of Artificial Sequence:  Enzymatic Nucleic Acid
  misc_feature (18)..(25): n stands for any nucleotide and can be optionally absent
ucucuucacugaugaggnnnnnnnnccgaaacagagag

SEQ ID NO: 5176 - RNA, 38 nt, Artificial Sequence
  Description of Artificial Sequence:  Enzymatic Nucleic Acid
  misc_feature (18)..(25): n stands for any nucleotide and can be optionally absent
gugcugaucugaugaggnnnnnnnnccgaaacgguccc

SEQ ID NO: 5177 - RNA, 38 nt, Artificial Sequence
  Description of Artificial Sequence:  Enzymatic Nucleic Acid
  misc_feature (18)..(25): n stands for any nucleotide and can be optionally absent
aaugugcucugaugaggnnnnnnnnccgaaaugacggu

SEQ ID NO: 5178 - RNA, 38 nt, Artificial Sequence
  Description of Artificial Sequence:  Enzymatic Nucleic Acid
  misc_feature (18)..(25): n stands for any nucleotide and can be optionally absent
cacuagggcugaugaggnnnnnnnnccgaaaugugcug

SEQ ID NO: 5179 - RNA, 38 nt, Artificial Sequence
  Description of Artificial Sequence:  Enzymatic Nucleic Acid
  misc_feature (18)..(25): n stands for any nucleotide and can be optionally absent
ucacuaggcugaugaggnnnnnnnnccgaaaaugugcu

SEQ ID NO: 5180 - RNA, 38 nt, Artificial Sequence
  Description of Artificial Sequence:  Enzymatic Nucleic Acid
  misc_feature (18)..(25): n stands for any nucleotide and can be optionally absent
aggcucaccugaugaggnnnnnnnnccgaaagggaaug

SEQ ID NO: 5181 - RNA, 38 nt, Artificial Sequence
  Description of Artificial Sequence:  Enzymatic Nucleic Acid
  misc_feature (18)..(25): n stands for any nucleotide and can be optionally absent
ggagccagcugaugaggnnnnnnnnccgaaaggcucac

SEQ ID NO: 5182 - RNA, 38 nt, Artificial Sequence
  Description of Artificial Sequence:  Enzymatic Nucleic Acid
  misc_feature (18)..(25): n stands for any nucleotide and can be optionally absent
gcugccagcugaugaggnnnnnnnnccgaaagccagua

SEQ ID NO: 5183 - RNA, 38 nt, Artificial Sequence
  Description of Artificial Sequence:  Enzymatic Nucleic Acid
  misc_feature (18)..(25): n stands for any nucleotide and can be optionally absent
uuccacaacugaugaggnnnnnnnnccgaaagccgcug

SEQ ID NO: 5184 - RNA, 38 nt, Artificial Sequence
  Description of Artificial Sequence:  Enzymatic Nucleic Acid
  misc_feature (18)..(25): n stands for any nucleotide and can be optionally absent
cuuccacacugaugaggnnnnnnnnccgaaaagccgcu

SEQ ID NO: 5185 - RNA, 38 nt, Artificial Sequence
  Description of Artificial Sequence:  Enzymatic Nucleic Acid
  misc_feature (18)..(25): n stands for any nucleotide and can be optionally absent
ucuuccaccugaugaggnnnnnnnnccgaaaaagccgc

SEQ ID NO: 5186 - RNA, 38 nt, Artificial Sequence
  Description of Artificial Sequence:  Enzymatic Nucleic Acid
  misc_feature (18)..(25): n stands for any nucleotide and can be optionally absent
uggcuagucugaugaggnnnnnnnnccgaaagucuucc

SEQ ID NO: 5187 - RNA, 38 nt, Artificial Sequence
  Description of Artificial Sequence:  Enzymatic Nucleic Acid
  misc_feature (18)..(25): n stands for any nucleotide and can be optionally absent
cuucuggccugaugaggnnnnnnnnccgaaagugaguc

SEQ ID NO: 5188 - RNA, 38 nt, Artificial Sequence
  Description of Artificial Sequence:  Enzymatic Nucleic Acid
  misc_feature (18)..(25): n stands for any nucleotide and can be optionally absent
guggagagcugaugaggnnnnnnnnccgaaacuguccc

SEQ ID NO: 5189 - RNA, 38 nt, Artificial Sequence
  Description of Artificial Sequence:  Enzymatic Nucleic Acid
  misc_feature (18)..(25): n stands for any nucleotide and can be optionally absent
uugguggacugaugaggnnnnnnnnccgaaaggacugu

SEQ ID NO: 5190 - RNA, 38 nt, Artificial Sequence
  Description of Artificial Sequence:  Enzymatic Nucleic Acid
  misc_feature (18)..(25): n stands for any nucleotide and can be optionally absent
ucuuggugcugaugaggnnnnnnnnccgaaagaggacu

SEQ ID NO: 5191 - RNA, 38 nt, Artificial Sequence
  Description of Artificial Sequence:  Enzymatic Nucleic Acid
  misc_feature (18)..(25): n stands for any nucleotide and can be optionally absent
uggauuuacugaugaggnnnnnnnnccgaaaucuuggu

SEQ ID NO: 5192 - RNA, 38 nt, Artificial Sequence
  Description of Artificial Sequence:  Enzymatic Nucleic Acid
  misc_feature (18)..(25): n stands for any nucleotide and can be optionally absent
uuuggauucugaugaggnnnnnnnnccgaaagaucuug

SEQ ID NO: 5193 - RNA, 38 nt, Artificial Sequence
  Description of Artificial Sequence:  Enzymatic Nucleic Acid
  misc_feature (18)..(25): n stands for any nucleotide and can be optionally absent
uuuguuugcugaugaggnnnnnnnnccgaaauuuagau

SEQ ID NO: 5194 - RNA, 38 nt, Artificial Sequence
  Description of Artificial Sequence:  Enzymatic Nucleic Acid
  misc_feature (18)..(25): n stands for any nucleotide and can be optionally absent
ucuggcuccugaugaggnnnnnnnnccgaaagccugcu

SEQ ID NO: 5195 - RNA, 38 nt, Artificial Sequence
  Description of Artificial Sequence:  Enzymatic Nucleic Acid
  misc_feature (18)..(25): n stands for any nucleotide and can be optionally absent
acaacaaacugaugaggnnnnnnnnccgaaauuugucc

SEQ ID NO: 5196 - RNA, 38 nt, Artificial Sequence
  Description of Artificial Sequence:  Enzymatic Nucleic Acid
  misc_feature (18)..(25): n stands for any nucleotide and can be optionally absent
gaacaacacugaugaggnnnnnnnnccgaaagauuugu

SEQ ID NO: 5197 - RNA, 38 nt, Artificial Sequence
  Description of Artificial Sequence:  Enzymatic Nucleic Acid
  misc_feature (18)..(25): n stands for any nucleotide and can be optionally absent
ggaacaaccugaugaggnnnnnnnnccgaaaagauuug

SEQ ID NO: 5198 - RNA, 38 nt, Artificial Sequence
  Description of Artificial Sequence:  Enzymatic Nucleic Acid
  misc_feature (18)..(25): n stands for any nucleotide and can be optionally absent
agaggaaccugaugaggnnnnnnnnccgaaacaaagau

SEQ ID NO: 5199 - RNA, 38 nt, Artificial Sequence
  Description of Artificial Sequence:  Enzymatic Nucleic Acid
  misc_feature (18)..(25): n stands for any nucleotide and can be optionally absent
agaagaggcugaugaggnnnnnnnnccgaaacaacaaa

SEQ ID NO: 5200 - RNA, 38 nt, Artificial Sequence
  Description of Artificial Sequence:  Enzymatic Nucleic Acid
  misc_feature (18)..(25): n stands for any nucleotide and can be optionally absent
aagaagagcugaugaggnnnnnnnnccgaaaacaacaa

SEQ ID NO: 5201 - RNA, 38 nt, Artificial Sequence
  Description of Artificial Sequence:  Enzymatic Nucleic Acid
  misc_feature (18)..(25): n stands for any nucleotide and can be optionally absent
guaaagaacugaugaggnnnnnnnnccgaaaggaacaa

SEQ ID NO: 5202 - RNA, 38 nt, Artificial Sequence
  Description of Artificial Sequence:  Enzymatic Nucleic Acid
  misc_feature (18)..(25): n stands for any nucleotide and can be optionally absent
guguaaagcugaugaggnnnnnnnnccgaaagaggaac

SEQ ID NO: 5203 - RNA, 38 nt, Artificial Sequence
  Description of Artificial Sequence:  Enzymatic Nucleic Acid
  misc_feature (18)..(25): n stands for any nucleotide and can be optionally absent
uguguaaacugaugaggnnnnnnnnccgaaaagaggaa

SEQ ID NO: 5204 - RNA, 38 nt, Artificial Sequence
  Description of Artificial Sequence:  Enzymatic Nucleic Acid
  misc_feature (18)..(25): n stands for any nucleotide and can be optionally absent
uauguguacugaugaggnnnnnnnnccgaaagaagagg

SEQ ID NO: 5205 - RNA, 38 nt, Artificial Sequence
  Description of Artificial Sequence:  Enzymatic Nucleic Acid
  misc_feature (18)..(25): n stands for any nucleotide and can be optionally absent
guaugugucugaugaggnnnnnnnnccgaaaagaagag

SEQ ID NO: 5206 - RNA, 38 nt, Artificial Sequence
  Description of Artificial Sequence:  Enzymatic Nucleic Acid
  misc_feature (18)..(25): n stands for any nucleotide and can be optionally absent
cguaugugcugaugaggnnnnnnnnccgaaaaagaaga

SEQ ID NO: 5207 - RNA, 38 nt, Artificial Sequence
  Description of Artificial Sequence:  Enzymatic Nucleic Acid
  misc_feature (18)..(25): n stands for any nucleotide and can be optionally absent
gguuugcgcugaugaggnnnnnnnnccgaaauguguaa

SEQ ID NO: 5208 - RNA, 38 nt, Artificial Sequence
  Description of Artificial Sequence:  Enzymatic Nucleic Acid
  misc_feature (18)..(25): n stands for any nucleotide and can be optionally absent
auuuauaacugaugaggnnnnnnnnccgaaauugccag

SEQ ID NO: 5209 - RNA, 38 nt, Artificial Sequence
  Description of Artificial Sequence:  Enzymatic Nucleic Acid
  misc_feature (18)..(25): n stands for any nucleotide and can be optionally absent
gauuuauacugaugaggnnnnnnnnccgaaaauugcca

SEQ ID NO: 5210 - RNA, 38 nt, Artificial Sequence
  Description of Artificial Sequence:  Enzymatic Nucleic Acid
  misc_feature (18)..(25): n stands for any nucleotide and can be optionally absent
ugauuuaucugaugaggnnnnnnnnccgaaaaauugcc

SEQ ID NO: 5211 - RNA, 38 nt, Artificial Sequence
  Description of Artificial Sequence:  Enzymatic Nucleic Acid
  misc_feature (18)..(25): n stands for any nucleotide and can be optionally absent
cugauuuacugaugaggnnnnnnnnccgaaaaaauugc

SEQ ID NO: 5212 - RNA, 38 nt, Artificial Sequence
  Description of Artificial Sequence:  Enzymatic Nucleic Acid
  misc_feature (18)..(25): n stands for any nucleotide and can be optionally absent
accugauucugaugaggnnnnnnnnccgaaauaaaauu

SEQ ID NO: 5213 - RNA, 38 nt, Artificial Sequence
  Description of Artificial Sequence:  Enzymatic Nucleic Acid
  misc_feature (18)..(25): n stands for any nucleotide and can be optionally absent
aguuaccucugaugaggnnnnnnnnccgaaauuuauaa

SEQ ID NO: 5214 - RNA, 38 nt, Artificial Sequence
  Description of Artificial Sequence:  Enzymatic Nucleic Acid
  misc_feature (18)..(25): n stands for any nucleotide and can be optionally absent
cuuccagucugaugaggnnnnnnnnccgaaaccugauu

SEQ ID NO: 5215 - RNA, 38 nt, Artificial Sequence
  Description of Artificial Sequence:  Enzymatic Nucleic Acid
  misc_feature (18)..(25): n stands for any nucleotide and can be optionally absent
cugaguuucugaugaggnnnnnnnnccgaaaccuccuu

SEQ ID NO: 5216 - RNA, 38 nt, Artificial Sequence
  Description of Artificial Sequence:  Enzymatic Nucleic Acid
  misc_feature (18)..(25): n stands for any nucleotide and can be optionally absent
ucugaguucugaugaggnnnnnnnnccgaaaaccuccu

SEQ ID NO: 5217 - RNA, 38 nt, Artificial Sequence
  Description of Artificial Sequence:  Enzymatic Nucleic Acid
  misc_feature (18)..(25): n stands for any nucleotide and can be optionally absent
uuuuuucucugaugaggnnnnnnnnccgaaaguuuaac

SEQ ID NO: 5218 - RNA, 38 nt, Artificial Sequence
  Description of Artificial Sequence:  Enzymatic Nucleic Acid
  misc_feature (18)..(25): n stands for any nucleotide and can be optionally absent
aauugacucugaugaggnnnnnnnnccgaaaggucuuc

SEQ ID NO: 5219 - RNA, 38 nt, Artificial Sequence
  Description of Artificial Sequence:  Enzymatic Nucleic Acid
  misc_feature (18)..(25): n stands for any nucleotide and can be optionally absent
agagaauucugaugaggnnnnnnnnccgaaacugaggu

SEQ ID NO: 5220 - RNA, 38 nt, Artificial Sequence
  Description of Artificial Sequence:  Enzymatic Nucleic Acid
  misc_feature (18)..(25): n stands for any nucleotide and can be optionally absent
aaguagagcugaugaggnnnnnnnnccgaaauugacug

SEQ ID NO: 5221 - RNA, 38 nt, Artificial Sequence
  Description of Artificial Sequence:  Enzymatic Nucleic Acid
  misc_feature (18)..(25): n stands for any nucleotide and can be optionally absent
aaaguagacugaugaggnnnnnnnnccgaaaauugacu

SEQ ID NO: 5222 - RNA, 38 nt, Artificial Sequence
  Description of Artificial Sequence:  Enzymatic Nucleic Acid
  misc_feature (18)..(25): n stands for any nucleotide and can be optionally absent
aaaaaguacugaugaggnnnnnnnnccgaaagaauuga

SEQ ID NO: 5223 - RNA, 38 nt, Artificial Sequence
  Description of Artificial Sequence:  Enzymatic Nucleic Acid
  misc_feature (18)..(25): n stands for any nucleotide and can be optionally absent
aaaaaaagcugaugaggnnnnnnnnccgaaagagaauu

SEQ ID NO: 5224 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaguagaga

SEQ ID NO: 5225 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaguagag

SEQ ID NO: 5226 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaaguaga

SEQ ID NO: 5227 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaaaguag

SEQ ID NO: 5228 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaaaagua

SEQ ID NO: 5229 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaaaaagu

SEQ ID NO: 5230 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaaaaaaaag

SEQ ID NO: 5231 - RNA, 38 nt, Artificial Sequence
  Description of Artificial Sequence:  Enzymatic Nucleic Acid
  misc_feature (18)..(25): n stands for any nucleotide and can be optionally absent
gaaaaaaacugaugaggnnnnnnnnccgaaaaaaaaaa

SEQ ID NO: 5232 - RNA, 38 nt, Artificial Sequence
  Description of Artificial Sequence:  Enzymatic Nucleic Acid
  misc_feature (18)..(25): n stands for any nucleotide and can be optionally absent
ggaaaaaacugaugaggnnnnnnnnccgaaaaaaaaaa

SEQ ID NO: 5233 - RNA, 38 nt, Artificial Sequence
  Description of Artificial Sequence:  Enzymatic Nucleic Acid
  misc_feature (18)..(25): n stands for any nucleotide and can be optionally absent
uggaaaaacugaugaggnnnnnnnnccgaaaaaaaaaa

SEQ ID NO: 5234 - RNA, 38 nt, Artificial Sequence
  Description of Artificial Sequence:  Enzymatic Nucleic Acid
  misc_feature (18)..(25): n stands for any nucleotide and can be optionally absent
uuggaaaacugaugaggnnnnnnnnccgaaaaaaaaaa

SEQ ID NO: 5235 - RNA, 38 nt, Artificial Sequence
  Description of Artificial Sequence:  Enzymatic Nucleic Acid
  misc_feature (18)..(25): n stands for any nucleotide and can be optionally absent
uuuggaaacugaugaggnnnnnnnnccgaaaaaaaaaa

SEQ ID NO: 5236 - RNA, 38 nt, Artificial Sequence
  Description of Artificial Sequence:  Enzymatic Nucleic Acid
  misc_feature (18)..(25): n stands for any nucleotide and can be optionally absent
auuuggaacugaugaggnnnnnnnnccgaaaaaaaaaa

SEQ ID NO: 5237 - RNA, 38 nt, Artificial Sequence
  Description of Artificial Sequence:  Enzymatic Nucleic Acid
  misc_feature (18)..(25): n stands for any nucleotide and can be optionally absent
gauuuggacugaugaggnnnnnnnnccgaaaaaaaaaa

SEQ ID NO: 5238 - RNA, 38 nt, Artificial Sequence
  Description of Artificial Sequence:  Enzymatic Nucleic Acid
  misc_feature (18)..(25): n stands for any nucleotide and can be optionally absent
ugauuuggcugaugaggnnnnnnnnccgaaaaaaaaaa

SEQ ID NO: 5239 - RNA, 38 nt, Artificial Sequence
  Description of Artificial Sequence:  Enzymatic Nucleic Acid
  misc_feature (18)..(25): n stands for any nucleotide and can be optionally absent
cugauuugcugaugaggnnnnnnnnccgaaaaaaaaaa

SEQ ID NO: 5240 - RNA, 38 nt, Artificial Sequence
  Description of Artificial Sequence:  Enzymatic Nucleic Acid
  misc_feature (18)..(25): n stands for any nucleotide and can be optionally absent
uauuaucucugaugaggnnnnnnnnccgaaauuuggaa

SEQ ID NO: 5241 - RNA, 38 nt, Artificial Sequence
  Description of Artificial Sequence:  Enzymatic Nucleic Acid
  misc_feature (18)..(25): n stands for any nucleotide and can be optionally absent
ugggcuaucugaugaggnnnnnnnnccgaaaucugauu

SEQ ID NO: 5242 - RNA, 38 nt, Artificial Sequence
  Description of Artificial Sequence:  Enzymatic Nucleic Acid
  misc_feature (18)..(25): n stands for any nucleotide and can be optionally absent
ugcugggccugaugaggnnnnnnnnccgaaauuaucug

SEQ ID NO: 5243 - RNA, 38 nt, Artificial Sequence
  Description of Artificial Sequence:  Enzymatic Nucleic Acid
  misc_feature (18)..(25): n stands for any nucleotide and can be optionally absent
guuaucaccugaugaggnnnnnnnnccgaaauuugcug

SEQ ID NO: 5244 - RNA, 38 nt, Artificial Sequence
  Description of Artificial Sequence:  Enzymatic Nucleic Acid
  misc_feature (18)..(25): n stands for any nucleotide and can be optionally absent
uuauuugucugaugaggnnnnnnnnccgaaaucacuau

SEQ ID NO: 5245 - RNA, 38 nt, Artificial Sequence
  Description of Artificial Sequence:  Enzymatic Nucleic Acid
  misc_feature (18)..(25): n stands for any nucleotide and can be optionally absent
uaagguuucugaugaggnnnnnnnnccgaaauuuguua

SEQ ID NO: 5246 - RNA, 38 nt, Artificial Sequence
  Description of Artificial Sequence:  Enzymatic Nucleic Acid
  misc_feature (18)..(25): n stands for any nucleotide and can be optionally absent
gaacagcucugaugaggnnnnnnnnccgaaagguuuua

SEQ ID NO: 5247 - RNA, 38 nt, Artificial Sequence
  Description of Artificial Sequence:  Enzymatic Nucleic Acid
  misc_feature (18)..(25): n stands for any nucleotide and can be optionally absent
ugaacagccugaugaggnnnnnnnnccgaaaagguuuu

SEQ ID NO: 5248 - RNA, 38 nt, Artificial Sequence
  Description of Artificial Sequence:  Enzymatic Nucleic Acid
  misc_feature (18)..(25): n stands for any nucleotide and can be optionally absent
aagacaugcugaugaggnnnnnnnnccgaaacagcuaa

SEQ ID NO: 5249 - RNA, 38 nt, Artificial Sequence
  Description of Artificial Sequence:  Enzymatic Nucleic Acid
  misc_feature (18)..(25): n stands for any nucleotide and can be optionally absent
caagacaucugaugaggnnnnnnnnccgaaaacagcua

SEQ ID NO: 5250 - RNA, 38 nt, Artificial Sequence
  Description of Artificial Sequence:  Enzymatic Nucleic Acid
  misc_feature (18)..(25): n stands for any nucleotide and can be optionally absent
gaaaucaacugaugaggnnnnnnnnccgaaacaugaac

SEQ ID NO: 5251 - RNA, 38 nt, Artificial Sequence
  Description of Artificial Sequence:  Enzymatic Nucleic Acid
  misc_feature (18)..(25): n stands for any nucleotide and can be optionally absent
uugaaauccugaugaggnnnnnnnnccgaaagacauga

SEQ ID NO: 5252 - RNA, 38 nt, Artificial Sequence
  Description of Artificial Sequence:  Enzymatic Nucleic Acid
  misc_feature (18)..(25): n stands for any nucleotide and can be optionally absent
auuauugacugaugaggnnnnnnnnccgaaaucaagac

SEQ ID NO: 5253 - RNA, 38 nt, Artificial Sequence
  Description of Artificial Sequence:  Enzymatic Nucleic Acid
  misc_feature (18)..(25): n stands for any nucleotide and can be optionally absent
aauuauugcugaugaggnnnnnnnnccgaaaaucaaga

SEQ ID NO: 5254 - RNA, 38 nt, Artificial Sequence
  Description of Artificial Sequence:  Enzymatic Nucleic Acid
  misc_feature (18)..(25): n stands for any nucleotide and can be optionally absent
uaauuauucugaugaggnnnnnnnnccgaaaaaucaag

SEQ ID NO: 5255 - RNA, 38 nt, Artificial Sequence
  Description of Artificial Sequence:  Enzymatic Nucleic Acid
  misc_feature (18)..(25): n stands for any nucleotide and can be optionally absent
gaauuaaucugaugaggnnnnnnnnccgaaauugaaau

SEQ ID NO: 5256 - RNA, 38 nt, Artificial Sequence
  Description of Artificial Sequence:  Enzymatic Nucleic Acid
  misc_feature (18)..(25): n stands for any nucleotide and can be optionally absent
uaagaauucugaugaggnnnnnnnnccgaaauuauuga

SEQ ID NO: 5257 - RNA, 38 nt, Artificial Sequence
  Description of Artificial Sequence:  Enzymatic Nucleic Acid
  misc_feature (18)..(25): n stands for any nucleotide and can be optionally absent
uuaagaaucugaugaggnnnnnnnnccgaaaauuauug

SEQ ID NO: 5258 - RNA, 38 nt, Artificial Sequence
  Description of Artificial Sequence:  Enzymatic Nucleic Acid
  misc_feature (18)..(25): n stands for any nucleotide and can be optionally absent
ugauuaagcugaugaggnnnnnnnnccgaaauuaauua

SEQ ID NO: 5259 - RNA, 38 nt, Artificial Sequence
  Description of Artificial Sequence:  Enzymatic Nucleic Acid
  misc_feature (18)..(25): n stands for any nucleotide and can be optionally absent
augauuaacugaugaggnnnnnnnnccgaaaauuaauu

SEQ ID NO: 5260 - RNA, 38 nt, Artificial Sequence
  Description of Artificial Sequence:  Enzymatic Nucleic Acid
  misc_feature (18)..(25): n stands for any nucleotide and can be optionally absent
uaaugauucugaugaggnnnnnnnnccgaaagaauuaa

SEQ ID NO: 5261 - RNA, 38 nt, Artificial Sequence
  Description of Artificial Sequence:  Enzymatic Nucleic Acid
  misc_feature (18)..(25): n stands for any nucleotide and can be optionally absent
uuaaugaucugaugaggnnnnnnnnccgaaaagaauua

SEQ ID NO: 5262 - RNA, 38 nt, Artificial Sequence
  Description of Artificial Sequence:  Enzymatic Nucleic Acid
  misc_feature (18)..(25): n stands for any nucleotide and can be optionally absent
cucuuaaucugaugaggnnnnnnnnccgaaauuaagaa

SEQ ID NO: 5263 - RNA, 38 nt, Artificial Sequence
  Description of Artificial Sequence:  Enzymatic Nucleic Acid
  misc_feature (18)..(25): n stands for any nucleotide and can be optionally absent
ggucucuucugaugaggnnnnnnnnccgaaaugauuaa

SEQ ID NO: 5264 - RNA, 38 nt, Artificial Sequence
  Description of Artificial Sequence:  Enzymatic Nucleic Acid
  misc_feature (18)..(25): n stands for any nucleotide and can be optionally absent
uggucucucugaugaggnnnnnnnnccgaaaaugauua

SEQ ID NO: 5265 - RNA, 38 nt, Artificial Sequence
  Description of Artificial Sequence:  Enzymatic Nucleic Acid
  misc_feature (18)..(25): n stands for any nucleotide and can be optionally absent
guauuuaucugaugaggnnnnnnnnccgaaauggucuc

SEQ ID NO: 5266 - RNA, 38 nt, Artificial Sequence
  Description of Artificial Sequence:  Enzymatic Nucleic Acid
  misc_feature (18)..(25): n stands for any nucleotide and can be optionally absent
ggaguauucugaugaggnnnnnnnnccgaaauuauggu

SEQ ID NO: 5267 - RNA, 38 nt, Artificial Sequence
  Description of Artificial Sequence:  Enzymatic Nucleic Acid
  misc_feature (18)..(25): n stands for any nucleotide and can be optionally absent
aaaaggagcugaugaggnnnnnnnnccgaaauuuauua

SEQ ID NO: 5268 - RNA, 38 nt, Artificial Sequence
  Description of Artificial Sequence:  Enzymatic Nucleic Acid
  misc_feature (18)..(25): n stands for any nucleotide and can be optionally absent
uugaaaagcugaugaggnnnnnnnnccgaaaguauuua

SEQ ID NO: 5269 - RNA, 38 nt, Artificial Sequence
  Description of Artificial Sequence:  Enzymatic Nucleic Acid
  misc_feature (18)..(25): n stands for any nucleotide and can be optionally absent
cucuugaacugaugaggnnnnnnnnccgaaaggaguau

SEQ ID NO: 5270 - RNA, 38 nt, Artificial Sequence
  Description of Artificial Sequence:  Enzymatic Nucleic Acid
  misc_feature (18)..(25): n stands for any nucleotide and can be optionally absent
ucucuugacugaugaggnnnnnnnnccgaaaaggagua

SEQ ID NO: 5271 - RNA, 38 nt, Artificial Sequence
  Description of Artificial Sequence:  Enzymatic Nucleic Acid
  misc_feature (18)..(25): n stands for any nucleotide and can be optionally absent
uucucuugcugaugaggnnnnnnnnccgaaaaaggagu

SEQ ID NO: 5272 - RNA, 38 nt, Artificial Sequence
  Description of Artificial Sequence:  Enzymatic Nucleic Acid
  misc_feature (18)..(25): n stands for any nucleotide and can be optionally absent
uuucucuucugaugaggnnnnnnnnccgaaaaaaggag

SEQ ID NO: 5273 - RNA, 38 nt, Artificial Sequence
  Description of Artificial Sequence:  Enzymatic Nucleic Acid
  misc_feature (18)..(25): n stands for any nucleotide and can be optionally absent
acaauucucugaugaggnnnnnnnnccgaaaugguuuu

SEQ ID NO: 5274 - RNA, 38 nt, Artificial Sequence
  Description of Artificial Sequence:  Enzymatic Nucleic Acid
  misc_feature (18)..(25): n stands for any nucleotide and can be optionally absent
aacaauuccugaugaggnnnnnnnnccgaaaaugguuu

SEQ ID NO: 5275 - RNA, 38 nt, Artificial Sequence
  Description of Artificial Sequence:  Enzymatic Nucleic Acid
  misc_feature (18)..(25): n stands for any nucleotide and can be optionally absent
ugaguaaccugaugaggnnnnnnnnccgaaauucuaau

SEQ ID NO: 5276 - RNA, 38 nt, Artificial Sequence
  Description of Artificial Sequence:  Enzymatic Nucleic Acid
  misc_feature (18)..(25): n stands for any nucleotide and can be optionally absent
agcugagucugaugaggnnnnnnnnccgaaacaauucu

SEQ ID NO: 5277 - RNA, 38 nt, Artificial Sequence
  Description of Artificial Sequence:  Enzymatic Nucleic Acid
  misc_feature (18)..(25): n stands for any nucleotide and can be optionally absent
gagcugagcugaugaggnnnnnnnnccgaaaacaauuc

SEQ ID NO: 5278 - RNA, 38 nt, Artificial Sequence
  Description of Artificial Sequence:  Enzymatic Nucleic Acid
  misc_feature (18)..(25): n stands for any nucleotide and can be optionally absent
aaggagcucugaugaggnnnnnnnnccgaaaguaacaa

SEQ ID NO: 5279 - RNA, 38 nt, Artificial Sequence
  Description of Artificial Sequence:  Enzymatic Nucleic Acid
  misc_feature (18)..(25): n stands for any nucleotide and can be optionally absent
guuugaagcugaugaggnnnnnnnnccgaaagcugagu

SEQ ID NO: 5280 - RNA, 38 nt, Artificial Sequence
  Description of Artificial Sequence:  Enzymatic Nucleic Acid
  misc_feature (18)..(25): n stands for any nucleotide and can be optionally absent
ugaguuugcugaugaggnnnnnnnnccgaaaggagcug

SEQ ID NO: 5281 - RNA, 38 nt, Artificial Sequence
  Description of Artificial Sequence:  Enzymatic Nucleic Acid
  misc_feature (18)..(25): n stands for any nucleotide and can be optionally absent
cugaguuucugaugaggnnnnnnnnccgaaaaggagcu

SEQ ID NO: 5282 - RNA, 38 nt, Artificial Sequence
  Description of Artificial Sequence:  Enzymatic Nucleic Acid
  misc_feature (18)..(25): n stands for any nucleotide and can be optionally absent
acaaaccucugaugaggnnnnnnnnccgaaaguuugaa

SEQ ID NO: 5283 - RNA, 38 nt, Artificial Sequence
  Description of Artificial Sequence:  Enzymatic Nucleic Acid
  misc_feature (18)..(25): n stands for any nucleotide and can be optionally absent
augcuacacugaugaggnnnnnnnnccgaaaccugagu

SEQ ID NO: 5284 - RNA, 38 nt, Artificial Sequence
  Description of Artificial Sequence:  Enzymatic Nucleic Acid
  misc_feature (18)..(25): n stands for any nucleotide and can be optionally absent
uaugcuaccugaugaggnnnnnnnnccgaaaaccugag

SEQ ID NO: 5285 - RNA, 38 nt, Artificial Sequence
  Description of Artificial Sequence:  Enzymatic Nucleic Acid
  misc_feature (18)..(25): n stands for any nucleotide and can be optionally absent
auguaugccugaugaggnnnnnnnnccgaaacaaaccu

SEQ ID NO: 5286 - RNA, 38 nt, Artificial Sequence
  Description of Artificial Sequence:  Enzymatic Nucleic Acid
  misc_feature (18)..(25): n stands for any nucleotide and can be optionally absent
gacucaugcugaugaggnnnnnnnnccgaaaugcuaca

SEQ ID NO: 5287 - RNA, 38 nt, Artificial Sequence
  Description of Artificial Sequence:  Enzymatic Nucleic Acid
  misc_feature (18)..(25): n stands for any nucleotide and can be optionally absent
gauggaugcugaugaggnnnnnnnnccgaaacucaugu

SEQ ID NO: 5288 - RNA, 38 nt, Artificial Sequence
  Description of Artificial Sequence:  Enzymatic Nucleic Acid
  misc_feature (18)..(25): n stands for any nucleotide and can be optionally absent
gacugaugcugaugaggnnnnnnnnccgaaauggacuc

SEQ ID NO: 5289 - RNA, 38 nt, Artificial Sequence
  Description of Artificial Sequence:  Enzymatic Nucleic Acid
  misc_feature (18)..(25): n stands for any nucleotide and can be optionally absent
cuuugacucugaugaggnnnnnnnnccgaaauggaugg

SEQ ID NO: 5290 - RNA, 38 nt, Artificial Sequence
  Description of Artificial Sequence:  Enzymatic Nucleic Acid
  misc_feature (18)..(25): n stands for any nucleotide and can be optionally absent
cauucuuucugaugaggnnnnnnnnccgaaacugaugg

SEQ ID NO: 5291 - RNA, 38 nt, Artificial Sequence
  Description of Artificial Sequence:  Enzymatic Nucleic Acid
  misc_feature (18)..(25): n stands for any nucleotide and can be optionally absent
ccagauggcugaugaggnnnnnnnnccgaaaccauucu

SEQ ID NO: 5292 - RNA, 38 nt, Artificial Sequence
  Description of Artificial Sequence:  Enzymatic Nucleic Acid
  misc_feature (18)..(25): n stands for any nucleotide and can be optionally absent
uccagaugcugaugaggnnnnnnnnccgaaaaccauuc

SEQ ID NO: 5293 - RNA, 38 nt, Artificial Sequence
  Description of Artificial Sequence:  Enzymatic Nucleic Acid
  misc_feature (18)..(25): n stands for any nucleotide and can be optionally absent
agacuccacugaugaggnnnnnnnnccgaaauggaacc

SEQ ID NO: 5294 - RNA, 38 nt, Artificial Sequence
  Description of Artificial Sequence:  Enzymatic Nucleic Acid
  misc_feature (18)..(25): n stands for any nucleotide and can be optionally absent
uacauuaacugaugaggnnnnnnnnccgaaacuccaga

SEQ ID NO: 5295 - RNA, 38 nt, Artificial Sequence
  Description of Artificial Sequence:  Enzymatic Nucleic Acid
  misc_feature (18)..(25): n stands for any nucleotide and can be optionally absent
ucuacauucugaugaggnnnnnnnnccgaaagacucca

SEQ ID NO: 5296 - RNA, 38 nt, Artificial Sequence
  Description of Artificial Sequence:  Enzymatic Nucleic Acid
  misc_feature (18)..(25): n stands for any nucleotide and can be optionally absent
uucuacaucugaugaggnnnnnnnnccgaaaagacucc

SEQ ID NO: 5297 - RNA, 38 nt, Artificial Sequence
  Description of Artificial Sequence:  Enzymatic Nucleic Acid
  misc_feature (18)..(25): n stands for any nucleotide and can be optionally absent
uuucuuuccugaugaggnnnnnnnnccgaaacauuaag

SEQ ID NO: 5298 - RNA, 38 nt, Artificial Sequence
  Description of Artificial Sequence:  Enzymatic Nucleic Acid
  misc_feature (18)..(25): n stands for any nucleotide and can be optionally absent
auuauuaccugaugaggnnnnnnnnccgaaagucucca

SEQ ID NO: 5299 - RNA, 38 nt, Artificial Sequence
  Description of Artificial Sequence:  Enzymatic Nucleic Acid
  misc_feature (18)..(25): n stands for any nucleotide and can be optionally absent
cucauuaucugaugaggnnnnnnnnccgaaacaagucu

SEQ ID NO: 5300 - RNA, 38 nt, Artificial Sequence
  Description of Artificial Sequence:  Enzymatic Nucleic Acid
  misc_feature (18)..(25): n stands for any nucleotide and can be optionally absent
uagcucaucugaugaggnnnnnnnnccgaaauuacaag

SEQ ID NO: 5301 - RNA, 38 nt, Artificial Sequence
  Description of Artificial Sequence:  Enzymatic Nucleic Acid
  misc_feature (18)..(25): n stands for any nucleotide and can be optionally absent
uuuguaaccugaugaggnnnnnnnnccgaaagcucauu

SEQ ID NO: 5302 - RNA, 38 nt, Artificial Sequence
  Description of Artificial Sequence:  Enzymatic Nucleic Acid
  misc_feature (18)..(25): n stands for any nucleotide and can be optionally absent
cacuuugucugaugaggnnnnnnnnccgaaacuagcuc

SEQ ID NO: 5303 - RNA, 38 nt, Artificial Sequence
  Description of Artificial Sequence:  Enzymatic Nucleic Acid
  misc_feature (18)..(25): n stands for any nucleotide and can be optionally absent
gcacuuugcugaugaggnnnnnnnnccgaaaacuagcu

SEQ ID NO: 5304 - RNA, 38 nt, Artificial Sequence
  Description of Artificial Sequence:  Enzymatic Nucleic Acid
  misc_feature (18)..(25): n stands for any nucleotide and can be optionally absent
uaaugaaccugaugaggnnnnnnnnccgaaagcacuuu

SEQ ID NO: 5305 - RNA, 38 nt, Artificial Sequence
  Description of Artificial Sequence:  Enzymatic Nucleic Acid
  misc_feature (18)..(25): n stands for any nucleotide and can be optionally absent
uuuuaaugcugaugaggnnnnnnnnccgaaacaagcac

SEQ ID NO: 5306 - RNA, 38 nt, Artificial Sequence
  Description of Artificial Sequence:  Enzymatic Nucleic Acid
  misc_feature (18)..(25): n stands for any nucleotide and can be optionally absent
auuuuaaucugaugaggnnnnnnnnccgaaaacaagca

SEQ ID NO: 5307 - RNA, 38 nt, Artificial Sequence
  Description of Artificial Sequence:  Enzymatic Nucleic Acid
  misc_feature (18)..(25): n stands for any nucleotide and can be optionally absent
gcuauuuucugaugaggnnnnnnnnccgaaaugaacaa

SEQ ID NO: 5308 - RNA, 38 nt, Artificial Sequence
  Description of Artificial Sequence:  Enzymatic Nucleic Acid
  misc_feature (18)..(25): n stands for any nucleotide and can be optionally absent
ugcuauuucugaugaggnnnnnnnnccgaaaaugaaca

SEQ ID NO: 5309 - RNA, 38 nt, Artificial Sequence
  Description of Artificial Sequence:  Enzymatic Nucleic Acid
  misc_feature (18)..(25): n stands for any nucleotide and can be optionally absent
uucagugccugaugaggnnnnnnnnccgaaauuuuaau

SEQ ID NO: 5310 - RNA, 38 nt, Artificial Sequence
  Description of Artificial Sequence:  Enzymatic Nucleic Acid
  misc_feature (18)..(25): n stands for any nucleotide and can be optionally absent
cauguuuccugaugaggnnnnnnnnccgaaauuuucag

SEQ ID NO: 5311 - RNA, 38 nt, Artificial Sequence
  Description of Artificial Sequence:  Enzymatic Nucleic Acid
  misc_feature (18)..(25): n stands for any nucleotide and can be optionally absent
uaucaguucugaugaggnnnnnnnnccgaaauucaugu

SEQ ID NO: 5312 - RNA, 38 nt, Artificial Sequence
  Description of Artificial Sequence:  Enzymatic Nucleic Acid
  misc_feature (18)..(25): n stands for any nucleotide and can be optionally absent
uuaucagucugaugaggnnnnnnnnccgaaaauucaug

SEQ ID NO: 5313 - RNA, 38 nt, Artificial Sequence
  Description of Artificial Sequence:  Enzymatic Nucleic Acid
  misc_feature (18)..(25): n stands for any nucleotide and can be optionally absent
uggaauaucugaugaggnnnnnnnnccgaaaucaguua

SEQ ID NO: 5314 - RNA, 38 nt, Artificial Sequence
  Description of Artificial Sequence:  Enzymatic Nucleic Acid
  misc_feature (18)..(25): n stands for any nucleotide and can be optionally absent
gauuggaacugaugaggnnnnnnnnccgaaauuaucag

SEQ ID NO: 5315 - RNA, 38 nt, Artificial Sequence
  Description of Artificial Sequence:  Enzymatic Nucleic Acid
  misc_feature (18)..(25): n stands for any nucleotide and can be optionally absent
augauuggcugaugaggnnnnnnnnccgaaauauuauc

SEQ ID NO: 5316 - RNA, 38 nt, Artificial Sequence
  Description of Artificial Sequence:  Enzymatic Nucleic Acid
  misc_feature (18)..(25): n stands for any nucleotide and can be optionally absent
aaugauugcugaugaggnnnnnnnnccgaaaauauuau

SEQ ID NO: 5317 - RNA, 38 nt, Artificial Sequence
  Description of Artificial Sequence:  Enzymatic Nucleic Acid
  misc_feature (18)..(25): n stands for any nucleotide and can be optionally absent
uggcaaaucugaugaggnnnnnnnnccgaaauuggaau

SEQ ID NO: 5318 - RNA, 38 nt, Artificial Sequence
  Description of Artificial Sequence:  Enzymatic Nucleic Acid
  misc_feature (18)..(25): n stands for any nucleotide and can be optionally absent
aaauggcacugaugaggnnnnnnnnccgaaaugauugg

SEQ ID NO: 5319 - RNA, 38 nt, Artificial Sequence
  Description of Artificial Sequence:  Enzymatic Nucleic Acid
  misc_feature (18)..(25): n stands for any nucleotide and can be optionally absent
uaaauggccugaugaggnnnnnnnnccgaaaaugauug

SEQ ID NO: 5320 - RNA, 38 nt, Artificial Sequence
  Description of Artificial Sequence:  Enzymatic Nucleic Acid
  misc_feature (18)..(25): n stands for any nucleotide and can be optionally absent
uugucauacugaugaggnnnnnnnnccgaaauggcaaa

SEQ ID NO: 5321 - RNA, 38 nt, Artificial Sequence
  Description of Artificial Sequence:  Enzymatic Nucleic Acid
  misc_feature (18)..(25): n stands for any nucleotide and can be optionally absent
uuugucaucugaugaggnnnnnnnnccgaaaauggcaa

SEQ ID NO: 5322 - RNA, 38 nt, Artificial Sequence
  Description of Artificial Sequence:  Enzymatic Nucleic Acid
  misc_feature (18)..(25): n stands for any nucleotide and can be optionally absent
uuuugucacugaugaggnnnnnnnnccgaaaaauggca

SEQ ID NO: 5323 - RNA, 38 nt, Artificial Sequence
  Description of Artificial Sequence:  Enzymatic Nucleic Acid
  misc_feature (18)..(25): n stands for any nucleotide and can be optionally absent
uuagugcccugaugaggnnnnnnnnccgaaaccauuuu

SEQ ID NO: 5324 - RNA, 38 nt, Artificial Sequence
  Description of Artificial Sequence:  Enzymatic Nucleic Acid
  misc_feature (18)..(25): n stands for any nucleotide and can be optionally absent
uucuuugucugaugaggnnnnnnnnccgaaagugccaa

SEQ ID NO: 5325 - RNA, 38 nt, Artificial Sequence
  Description of Artificial Sequence:  Enzymatic Nucleic Acid
  misc_feature (18)..(25): n stands for any nucleotide and can be optionally absent
cugaaaggcugaugaggnnnnnnnnccgaaagugcucg

SEQ ID NO: 5326 - RNA, 38 nt, Artificial Sequence
  Description of Artificial Sequence:  Enzymatic Nucleic Acid
  misc_feature (18)..(25): n stands for any nucleotide and can be optionally absent
ucugaaagcugaugaggnnnnnnnnccgaaaagugcuc

SEQ ID NO: 5327 - RNA, 38 nt, Artificial Sequence
  Description of Artificial Sequence:  Enzymatic Nucleic Acid
  misc_feature (18)..(25): n stands for any nucleotide and can be optionally absent
aacucugacugaugaggnnnnnnnnccgaaaggaagug

SEQ ID NO: 5328 - RNA, 38 nt, Artificial Sequence
  Description of Artificial Sequence:  Enzymatic Nucleic Acid
  misc_feature (18)..(25): n stands for any nucleotide and can be optionally absent
aaacucugcugaugaggnnnnnnnnccgaaaaggaagu

SEQ ID NO: 5329 - RNA, 38 nt, Artificial Sequence
  Description of Artificial Sequence:  Enzymatic Nucleic Acid
  misc_feature (18)..(25): n stands for any nucleotide and can be optionally absent
gaaacucucugaugaggnnnnnnnnccgaaaaaggaag

SEQ ID NO: 5330 - RNA, 38 nt, Artificial Sequence
  Description of Artificial Sequence:  Enzymatic Nucleic Acid
  misc_feature (18)..(25): n stands for any nucleotide and can be optionally absent
aucucagacugaugaggnnnnnnnnccgaaacucugaa

SEQ ID NO: 5331 - RNA, 38 nt, Artificial Sequence
  Description of Artificial Sequence:  Enzymatic Nucleic Acid
  misc_feature (18)..(25): n stands for any nucleotide and can be optionally absent
uaucucagcugaugaggnnnnnnnnccgaaaacucuga

SEQ ID NO: 5332 - RNA, 38 nt, Artificial Sequence
  Description of Artificial Sequence:  Enzymatic Nucleic Acid
  misc_feature (18)..(25): n stands for any nucleotide and can be optionally absent
uuaucucacugaugaggnnnnnnnnccgaaaaacucug

SEQ ID NO: 5333 - RNA, 38 nt, Artificial Sequence
  Description of Artificial Sequence:  Enzymatic Nucleic Acid
  misc_feature (18)..(25): n stands for any nucleotide and can be optionally absent
acguacaucugaugaggnnnnnnnnccgaaaucucaga

SEQ ID NO: 5334 - RNA, 38 nt, Artificial Sequence
  Description of Artificial Sequence:  Enzymatic Nucleic Acid
  misc_feature (18)..(25): n stands for any nucleotide and can be optionally absent
guuccacgcugaugaggnnnnnnnnccgaaacauuauc

SEQ ID NO: 5335 - RNA, 38 nt, Artificial Sequence
  Description of Artificial Sequence:  Enzymatic Nucleic Acid
  misc_feature (18)..(25): n stands for any nucleotide and can be optionally absent
uccacccacugaugaggnnnnnnnnccgaaacuguucc

SEQ ID NO: 5336 - RNA, 38 nt, Artificial Sequence
  Description of Artificial Sequence:  Enzymatic Nucleic Acid
  misc_feature (18)..(25): n stands for any nucleotide and can be optionally absent
aagacacacugaugaggnnnnnnnnccgaaacuugcac

SEQ ID NO: 5337 - RNA, 38 nt, Artificial Sequence
  Description of Artificial Sequence:  Enzymatic Nucleic Acid
  misc_feature (18)..(25): n stands for any nucleotide and can be optionally absent
acugacaacugaugaggnnnnnnnnccgaaacacagac

SEQ ID NO: 5338 - RNA, 38 nt, Artificial Sequence
  Description of Artificial Sequence:  Enzymatic Nucleic Acid
  misc_feature (18)..(25): n stands for any nucleotide and can be optionally absent
ggacugaccugaugaggnnnnnnnnccgaaagacacag

SEQ ID NO: 5339 - RNA, 38 nt, Artificial Sequence
  Description of Artificial Sequence:  Enzymatic Nucleic Acid
  misc_feature (18)..(25): n stands for any nucleotide and can be optionally absent
cuuggacucugaugaggnnnnnnnnccgaaacaagaca

SEQ ID NO: 5340 - RNA, 38 nt, Artificial Sequence
  Description of Artificial Sequence:  Enzymatic Nucleic Acid
  misc_feature (18)..(25): n stands for any nucleotide and can be optionally absent
acuucuugcugaugaggnnnnnnnnccgaaacugacaa

SEQ ID NO: 5341 - RNA, 38 nt, Artificial Sequence
  Description of Artificial Sequence:  Enzymatic Nucleic Acid
  misc_feature (18)..(25): n stands for any nucleotide and can be optionally absent
cuaaaauucugaugaggnnnnnnnnccgaaacaucucg

SEQ ID NO: 5342 - RNA, 38 nt, Artificial Sequence
  Description of Artificial Sequence:  Enzymatic Nucleic Acid
  misc_feature (18)..(25): n stands for any nucleotide and can be optionally absent
ccuaaaaucugaugaggnnnnnnnnccgaaaacaucuc

SEQ ID NO: 5343 - RNA, 38 nt, Artificial Sequence
  Description of Artificial Sequence:  Enzymatic Nucleic Acid
  misc_feature (18)..(25): n stands for any nucleotide and can be optionally absent
gucccuaacugaugaggnnnnnnnnccgaaauuaacau

SEQ ID NO: 5344 - RNA, 38 nt, Artificial Sequence
  Description of Artificial Sequence:  Enzymatic Nucleic Acid
  misc_feature (18)..(25): n stands for any nucleotide and can be optionally absent
ggucccuacugaugaggnnnnnnnnccgaaaauuaaca

SEQ ID NO: 5345 - RNA, 38 nt, Artificial Sequence
  Description of Artificial Sequence:  Enzymatic Nucleic Acid
  misc_feature (18)..(25): n stands for any nucleotide and can be optionally absent
gggucccucugaugaggnnnnnnnnccgaaaaauuaac

SEQ ID NO: 5346 - RNA, 38 nt, Artificial Sequence
  Description of Artificial Sequence:  Enzymatic Nucleic Acid
  misc_feature (18)..(25): n stands for any nucleotide and can be optionally absent
cggguccccugaugaggnnnnnnnnccgaaaaaauuaa

SEQ ID NO: 5347 - RNA, 38 nt, Artificial Sequence
  Description of Artificial Sequence:  Enzymatic Nucleic Acid
  misc_feature (18)..(25): n stands for any nucleotide and can be optionally absent
uaggaaaccugaugaggnnnnnnnnccgaaaggcacgg

SEQ ID NO: 5348 - RNA, 38 nt, Artificial Sequence
  Description of Artificial Sequence:  Enzymatic Nucleic Acid
  misc_feature (18)..(25): n stands for any nucleotide and can be optionally absent
ggcuaggacugaugaggnnnnnnnnccgaaacaaggca

SEQ ID NO: 5349 - RNA, 38 nt, Artificial Sequence
  Description of Artificial Sequence:  Enzymatic Nucleic Acid
  misc_feature (18)..(25): n stands for any nucleotide and can be optionally absent
gggcuaggcugaugaggnnnnnnnnccgaaaacaaggc

SEQ ID NO: 5350 - RNA, 38 nt, Artificial Sequence
  Description of Artificial Sequence:  Enzymatic Nucleic Acid
  misc_feature (18)..(25): n stands for any nucleotide and can be optionally absent
ugggcuagcugaugaggnnnnnnnnccgaaaaacaagg

SEQ ID NO: 5351 - RNA, 38 nt, Artificial Sequence
  Description of Artificial Sequence:  Enzymatic Nucleic Acid
  misc_feature (18)..(25): n stands for any nucleotide and can be optionally absent
uugugggccugaugaggnnnnnnnnccgaaaggaaaca

SEQ ID NO: 5352 - RNA, 38 nt, Artificial Sequence
  Description of Artificial Sequence:  Enzymatic Nucleic Acid
  misc_feature (18)..(25): n stands for any nucleotide and can be optionally absent
aucuguuucugaugaggnnnnnnnnccgaaauguuugc

SEQ ID NO: 5353 - RNA, 38 nt, Artificial Sequence
  Description of Artificial Sequence:  Enzymatic Nucleic Acid
  misc_feature (18)..(25): n stands for any nucleotide and can be optionally absent
cuagcgagcugaugaggnnnnnnnnccgaaaucuguuu

SEQ ID NO: 5354 - RNA, 38 nt, Artificial Sequence
  Description of Artificial Sequence:  Enzymatic Nucleic Acid
  misc_feature (18)..(25): n stands for any nucleotide and can be optionally absent
aggcuagccugaugaggnnnnnnnnccgaaaguaucug

SEQ ID NO: 5355 - RNA, 38 nt, Artificial Sequence
  Description of Artificial Sequence:  Enzymatic Nucleic Acid
  misc_feature (18)..(25): n stands for any nucleotide and can be optionally absent
aaugaggccugaugaggnnnnnnnnccgaaagcgagua

SEQ ID NO: 5356 - RNA, 38 nt, Artificial Sequence
  Description of Artificial Sequence:  Enzymatic Nucleic Acid
  misc_feature (18)..(25): n stands for any nucleotide and can be optionally absent
auuuaaaucugaugaggnnnnnnnnccgaaaggcuagc

SEQ ID NO: 5357 - RNA, 38 nt, Artificial Sequence
  Description of Artificial Sequence:  Enzymatic Nucleic Acid
  misc_feature (18)..(25): n stands for any nucleotide and can be optionally absent
ucaauuuacugaugaggnnnnnnnnccgaaaugaggcu

SEQ ID NO: 5358 - RNA, 38 nt, Artificial Sequence
  Description of Artificial Sequence:  Enzymatic Nucleic Acid
  misc_feature (18)..(25): n stands for any nucleotide and can be optionally absent
aucaauuucugaugaggnnnnnnnnccgaaaaugaggc

SEQ ID NO: 5359 - RNA, 38 nt, Artificial Sequence
  Description of Artificial Sequence:  Enzymatic Nucleic Acid
  misc_feature (18)..(25): n stands for any nucleotide and can be optionally absent
aaucaauucugaugaggnnnnnnnnccgaaaaaugagg

SEQ ID NO: 5360 - RNA, 38 nt, Artificial Sequence
  Description of Artificial Sequence:  Enzymatic Nucleic Acid
  misc_feature (18)..(25): n stands for any nucleotide and can be optionally absent
cuuuaauccugaugaggnnnnnnnnccgaaauuuaaau

SEQ ID NO: 5361 - RNA, 38 nt, Artificial Sequence
  Description of Artificial Sequence:  Enzymatic Nucleic Acid
  misc_feature (18)..(25): n stands for any nucleotide and can be optionally absent
ccuccuuucugaugaggnnnnnnnnccgaaaucaauuu

SEQ ID NO: 5362 - RNA, 38 nt, Artificial Sequence
  Description of Artificial Sequence:  Enzymatic Nucleic Acid
  misc_feature (18)..(25): n stands for any nucleotide and can be optionally absent
uccuccuucugaugaggnnnnnnnnccgaaaaucaauu

SEQ ID NO: 5363 - RNA, 38 nt, Artificial Sequence
  Description of Artificial Sequence:  Enzymatic Nucleic Acid
  misc_feature (18)..(25): n stands for any nucleotide and can be optionally absent
cggccaaacugaugaggnnnnnnnnccgaaaugcacuc

SEQ ID NO: 5364 - RNA, 38 nt, Artificial Sequence
  Description of Artificial Sequence:  Enzymatic Nucleic Acid
  misc_feature (18)..(25): n stands for any nucleotide and can be optionally absent
gucggccacugaugaggnnnnnnnnccgaaagaugcac

SEQ ID NO: 5365 - RNA, 38 nt, Artificial Sequence
  Description of Artificial Sequence:  Enzymatic Nucleic Acid
  misc_feature (18)..(25): n stands for any nucleotide and can be optionally absent
ugucggcccugaugaggnnnnnnnnccgaaaagaugca

SEQ ID NO: 5366 - RNA, 38 nt, Artificial Sequence
  Description of Artificial Sequence:  Enzymatic Nucleic Acid
  misc_feature (18)..(25): n stands for any nucleotide and can be optionally absent
cacacagucugaugaggnnnnnnnnccgaaacaccacu

SEQ ID NO: 5367 - RNA, 38 nt, Artificial Sequence
  Description of Artificial Sequence:  Enzymatic Nucleic Acid
  misc_feature (18)..(25): n stands for any nucleotide and can be optionally absent
aacacacacugaugaggnnnnnnnnccgaaacacccac

SEQ ID NO: 5368 - RNA, 38 nt, Artificial Sequence
  Description of Artificial Sequence:  Enzymatic Nucleic Acid
  misc_feature (18)..(25): n stands for any nucleotide and can be optionally absent
augcacaacugaugaggnnnnnnnnccgaaacacacau

SEQ ID NO: 5369 - RNA, 38 nt, Artificial Sequence
  Description of Artificial Sequence:  Enzymatic Nucleic Acid
  misc_feature (18)..(25): n stands for any nucleotide and can be optionally absent
uaugcacacugaugaggnnnnnnnnccgaaaacacaca

SEQ ID NO: 5370 - RNA, 38 nt, Artificial Sequence
  Description of Artificial Sequence:  Enzymatic Nucleic Acid
  misc_feature (18)..(25): n stands for any nucleotide and can be optionally absent
uuaugcaccugaugaggnnnnnnnnccgaaaaacacac

SEQ ID NO: 5371 - RNA, 38 nt, Artificial Sequence
  Description of Artificial Sequence:  Enzymatic Nucleic Acid
  misc_feature (18)..(25): n stands for any nucleotide and can be optionally absent
uaaauagucugaugaggnnnnnnnnccgaaaugcacaa

SEQ ID NO: 5372 - RNA, 38 nt, Artificial Sequence
  Description of Artificial Sequence:  Enzymatic Nucleic Acid
  misc_feature (18)..(25): n stands for any nucleotide and can be optionally absent
uccuuaaacugaugaggnnnnnnnnccgaaaguuaugc

SEQ ID NO: 5373 - RNA, 38 nt, Artificial Sequence
  Description of Artificial Sequence:  Enzymatic Nucleic Acid
  misc_feature (18)..(25): n stands for any nucleotide and can be optionally absent
uuuccuuacugaugaggnnnnnnnnccgaaauaguuau

SEQ ID NO: 5374 - RNA, 38 nt, Artificial Sequence
  Description of Artificial Sequence:  Enzymatic Nucleic Acid
  misc_feature (18)..(25): n stands for any nucleotide and can be optionally absent
guuuccuucugaugaggnnnnnnnnccgaaaauaguua

SEQ ID NO: 5375 - RNA, 38 nt, Artificial Sequence
  Description of Artificial Sequence:  Enzymatic Nucleic Acid
  misc_feature (18)..(25): n stands for any nucleotide and can be optionally absent
aguuuccucugaugaggnnnnnnnnccgaaaaauaguu

SEQ ID NO: 5376 - RNA, 38 nt, Artificial Sequence
  Description of Artificial Sequence:  Enzymatic Nucleic Acid
  misc_feature (18)..(25): n stands for any nucleotide and can be optionally absent
aacuuuaacugaugaggnnnnnnnnccgaaauuccagu

SEQ ID NO: 5377 - RNA, 38 nt, Artificial Sequence
  Description of Artificial Sequence:  Enzymatic Nucleic Acid
  misc_feature (18)..(25): n stands for any nucleotide and can be optionally absent
uaacuuuacugaugaggnnnnnnnnccgaaaauuccag

SEQ ID NO: 5378 - RNA, 38 nt, Artificial Sequence
  Description of Artificial Sequence:  Enzymatic Nucleic Acid
  misc_feature (18)..(25): n stands for any nucleotide and can be optionally absent
guaacuuucugaugaggnnnnnnnnccgaaaaauucca

SEQ ID NO: 5379 - RNA, 38 nt, Artificial Sequence
  Description of Artificial Sequence:  Enzymatic Nucleic Acid
  misc_feature (18)..(25): n stands for any nucleotide and can be optionally absent
aguaacuucugaugaggnnnnnnnnccgaaaaaauucc

SEQ ID NO: 5380 - RNA, 38 nt, Artificial Sequence
  Description of Artificial Sequence:  Enzymatic Nucleic Acid
  misc_feature (18)..(25): n stands for any nucleotide and can be optionally absent
auaaaagucugaugaggnnnnnnnnccgaaacuuuaaa

SEQ ID NO: 5381 - RNA, 38 nt, Artificial Sequence
  Description of Artificial Sequence:  Enzymatic Nucleic Acid
  misc_feature (18)..(25): n stands for any nucleotide and can be optionally absent
uauaaaagcugaugaggnnnnnnnnccgaaaacuuuaa

SEQ ID NO: 5382 - RNA, 38 nt, Artificial Sequence
  Description of Artificial Sequence:  Enzymatic Nucleic Acid
  misc_feature (18)..(25): n stands for any nucleotide and can be optionally absent
uuguauaacugaugaggnnnnnnnnccgaaaguaacuu

SEQ ID NO: 5383 - RNA, 38 nt, Artificial Sequence
  Description of Artificial Sequence:  Enzymatic Nucleic Acid
  misc_feature (18)..(25): n stands for any nucleotide and can be optionally absent
uuuguauacugaugaggnnnnnnnnccgaaaaguaacu

SEQ ID NO: 5384 - RNA, 38 nt, Artificial Sequence
  Description of Artificial Sequence:  Enzymatic Nucleic Acid
  misc_feature (18)..(25): n stands for any nucleotide and can be optionally absent
guuuguaucugaugaggnnnnnnnnccgaaaaaguaac

SEQ ID NO: 5385 - RNA, 38 nt, Artificial Sequence
  Description of Artificial Sequence:  Enzymatic Nucleic Acid
  misc_feature (18)..(25): n stands for any nucleotide and can be optionally absent
gguuuguacugaugaggnnnnnnnnccgaaaaaaguaa

SEQ ID NO: 5386 - RNA, 38 nt, Artificial Sequence
  Description of Artificial Sequence:  Enzymatic Nucleic Acid
  misc_feature (18)..(25): n stands for any nucleotide and can be optionally absent
uugguuugcugaugaggnnnnnnnnccgaaauaaaagu

SEQ ID NO: 5387 - RNA, 38 nt, Artificial Sequence
  Description of Artificial Sequence:  Enzymatic Nucleic Acid
  misc_feature (18)..(25): n stands for any nucleotide and can be optionally absent
guagcauacugaugaggnnnnnnnnccgaaauucuugg

SEQ ID NO: 5388 - RNA, 38 nt, Artificial Sequence
  Description of Artificial Sequence:  Enzymatic Nucleic Acid
  misc_feature (18)..(25): n stands for any nucleotide and can be optionally absent
cuguagcacugaugaggnnnnnnnnccgaaauauucuu

SEQ ID NO: 5389 - RNA, 38 nt, Artificial Sequence
  Description of Artificial Sequence:  Enzymatic Nucleic Acid
  misc_feature (18)..(25): n stands for any nucleotide and can be optionally absent
uauaucugcugaugaggnnnnnnnnccgaaagcauaua

SEQ ID NO: 5390 - RNA, 38 nt, Artificial Sequence
  Description of Artificial Sequence:  Enzymatic Nucleic Acid
  misc_feature (18)..(25): n stands for any nucleotide and can be optionally absent
cugucuuacugaugaggnnnnnnnnccgaaaucuguag

SEQ ID NO: 5391 - RNA, 38 nt, Artificial Sequence
  Description of Artificial Sequence:  Enzymatic Nucleic Acid
  misc_feature (18)..(25): n stands for any nucleotide and can be optionally absent
gucugucucugaugaggnnnnnnnnccgaaauaucugu

SEQ ID NO: 5392 - RNA, 38 nt, Artificial Sequence
  Description of Artificial Sequence:  Enzymatic Nucleic Acid
  misc_feature (18)..(25): n stands for any nucleotide and can be optionally absent
uaggaccacugaugaggnnnnnnnnccgaaaccauguc

SEQ ID NO: 5393 - RNA, 38 nt, Artificial Sequence
  Description of Artificial Sequence:  Enzymatic Nucleic Acid
  misc_feature (18)..(25): n stands for any nucleotide and can be optionally absent
auaggacccugaugaggnnnnnnnnccgaaaaccaugu

SEQ ID NO: 5394 - RNA, 38 nt, Artificial Sequence
  Description of Artificial Sequence:  Enzymatic Nucleic Acid
  misc_feature (18)..(25): n stands for any nucleotide and can be optionally absent
aaauauagcugaugaggnnnnnnnnccgaaaccaaacc

SEQ ID NO: 5395 - RNA, 38 nt, Artificial Sequence
  Description of Artificial Sequence:  Enzymatic Nucleic Acid
  misc_feature (18)..(25): n stands for any nucleotide and can be optionally absent
uagaaauacugaugaggnnnnnnnnccgaaaggaccaa

SEQ ID NO: 5396 - RNA, 38 nt, Artificial Sequence
  Description of Artificial Sequence:  Enzymatic Nucleic Acid
  misc_feature (18)..(25): n stands for any nucleotide and can be optionally absent
acuagaaacugaugaggnnnnnnnnccgaaauaggacc

SEQ ID NO: 5397 - RNA, 38 nt, Artificial Sequence
  Description of Artificial Sequence:  Enzymatic Nucleic Acid
  misc_feature (18)..(25): n stands for any nucleotide and can be optionally absent
ugacuagacugaugaggnnnnnnnnccgaaauauagga

SEQ ID NO: 5398 - RNA, 38 nt, Artificial Sequence
  Description of Artificial Sequence:  Enzymatic Nucleic Acid
  misc_feature (18)..(25): n stands for any nucleotide and can be optionally absent
augacuagcugaugaggnnnnnnnnccgaaaauauagg

SEQ ID NO: 5399 - RNA, 38 nt, Artificial Sequence
  Description of Artificial Sequence:  Enzymatic Nucleic Acid
  misc_feature (18)..(25): n stands for any nucleotide and can be optionally absent
caugacuacugaugaggnnnnnnnnccgaaaaauauag

SEQ ID NO: 5400 - RNA, 38 nt, Artificial Sequence
  Description of Artificial Sequence:  Enzymatic Nucleic Acid
  misc_feature (18)..(25): n stands for any nucleotide and can be optionally absent
aucaugaccugaugaggnnnnnnnnccgaaagaaauau

SEQ ID NO: 5401 - RNA, 38 nt, Artificial Sequence
  Description of Artificial Sequence:  Enzymatic Nucleic Acid
  misc_feature (18)..(25): n stands for any nucleotide and can be optionally absent
uucaucaucugaugaggnnnnnnnnccgaaacuagaaa

SEQ ID NO: 5402 - RNA, 38 nt, Artificial Sequence
  Description of Artificial Sequence:  Enzymatic Nucleic Acid
  misc_feature (18)..(25): n stands for any nucleotide and can be optionally absent
auacaaaacugaugaggnnnnnnnnccgaaacauucau

SEQ ID NO: 5403 - RNA, 38 nt, Artificial Sequence
  Description of Artificial Sequence:  Enzymatic Nucleic Acid
  misc_feature (18)..(25): n stands for any nucleotide and can be optionally absent
guauacaacugaugaggnnnnnnnnccgaaauacauuc

SEQ ID NO: 5404 - RNA, 38 nt, Artificial Sequence
  Description of Artificial Sequence:  Enzymatic Nucleic Acid
  misc_feature (18)..(25): n stands for any nucleotide and can be optionally absent
gguauacacugaugaggnnnnnnnnccgaaaauacauu

SEQ ID NO: 5405 - RNA, 38 nt, Artificial Sequence
  Description of Artificial Sequence:  Enzymatic Nucleic Acid
  misc_feature (18)..(25): n stands for any nucleotide and can be optionally absent
ugguauaccugaugaggnnnnnnnnccgaaaaauacau

SEQ ID NO: 5406 - RNA, 38 nt, Artificial Sequence
  Description of Artificial Sequence:  Enzymatic Nucleic Acid
  misc_feature (18)..(25): n stands for any nucleotide and can be optionally absent
agaugguacugaugaggnnnnnnnnccgaaacaaaaua

SEQ ID NO: 5407 - RNA, 38 nt, Artificial Sequence
  Description of Artificial Sequence:  Enzymatic Nucleic Acid
  misc_feature (18)..(25): n stands for any nucleotide and can be optionally absent
gaagauggcugaugaggnnnnnnnnccgaaauacaaaa

SEQ ID NO: 5408 - RNA, 38 nt, Artificial Sequence
  Description of Artificial Sequence:  Enzymatic Nucleic Acid
  misc_feature (18)..(25): n stands for any nucleotide and can be optionally absent
uauaugaacugaugaggnnnnnnnnccgaaaugguaua

SEQ ID NO: 5409 - RNA, 38 nt, Artificial Sequence
  Description of Artificial Sequence:  Enzymatic Nucleic Acid
  misc_feature (18)..(25): n stands for any nucleotide and can be optionally absent
auuauaugcugaugaggnnnnnnnnccgaaagauggua

SEQ ID NO: 5410 - RNA, 38 nt, Artificial Sequence
  Description of Artificial Sequence:  Enzymatic Nucleic Acid
  misc_feature (18)..(25): n stands for any nucleotide and can be optionally absent
uauuauaucugaugaggnnnnnnnnccgaaaagauggu

SEQ ID NO: 5411 - RNA, 38 nt, Artificial Sequence
  Description of Artificial Sequence:  Enzymatic Nucleic Acid
  misc_feature (18)..(25): n stands for any nucleotide and can be optionally absent
guauauuacugaugaggnnnnnnnnccgaaaugaagau

SEQ ID NO: 5412 - RNA, 38 nt, Artificial Sequence
  Description of Artificial Sequence:  Enzymatic Nucleic Acid
  misc_feature (18)..(25): n stands for any nucleotide and can be optionally absent
aaguauaucugaugaggnnnnnnnnccgaaauaugaag

SEQ ID NO: 5413 - RNA, 38 nt, Artificial Sequence
  Description of Artificial Sequence:  Enzymatic Nucleic Acid
  misc_feature (18)..(25): n stands for any nucleotide and can be optionally absent
uuuaaguacugaugaggnnnnnnnnccgaaauuauaug

SEQ ID NO: 5414 - RNA, 38 nt, Artificial Sequence
  Description of Artificial Sequence:  Enzymatic Nucleic Acid
  misc_feature (18)..(25): n stands for any nucleotide and can be optionally absent
uuuuuaagcugaugaggnnnnnnnnccgaaauauuaua

SEQ ID NO: 5415 - RNA, 38 nt, Artificial Sequence
  Description of Artificial Sequence:  Enzymatic Nucleic Acid
  misc_feature (18)..(25): n stands for any nucleotide and can be optionally absent
auauuuuucugaugaggnnnnnnnnccgaaaguauauu

SEQ ID NO: 5416 - RNA, 38 nt, Artificial Sequence
  Description of Artificial Sequence:  Enzymatic Nucleic Acid
  misc_feature (18)..(25): n stands for any nucleotide and can be optionally absent
aauauuuucugaugaggnnnnnnnnccgaaaaguauau

SEQ ID NO: 5417 - RNA, 38 nt, Artificial Sequence
  Description of Artificial Sequence:  Enzymatic Nucleic Acid
  misc_feature (18)..(25): n stands for any nucleotide and can be optionally absent
uuaagaaacugaugaggnnnnnnnnccgaaauuuuuaa

SEQ ID NO: 5418 - RNA, 38 nt, Artificial Sequence
  Description of Artificial Sequence:  Enzymatic Nucleic Acid
  misc_feature (18)..(25): n stands for any nucleotide and can be optionally absent
aauuaagacugaugaggnnnnnnnnccgaaauauuuuu

SEQ ID NO: 5419 - RNA, 38 nt, Artificial Sequence
  Description of Artificial Sequence:  Enzymatic Nucleic Acid
  misc_feature (18)..(25): n stands for any nucleotide and can be optionally absent
caauuaagcugaugaggnnnnnnnnccgaaaauauuuu

SEQ ID NO: 5420 - RNA, 38 nt, Artificial Sequence
  Description of Artificial Sequence:  Enzymatic Nucleic Acid
  misc_feature (18)..(25): n stands for any nucleotide and can be optionally absent
ccaauuaacugaugaggnnnnnnnnccgaaaaauauuu

SEQ ID NO: 5421 - RNA, 38 nt, Artificial Sequence
  Description of Artificial Sequence:  Enzymatic Nucleic Acid
  misc_feature (18)..(25): n stands for any nucleotide and can be optionally absent
ucccaauucugaugaggnnnnnnnnccgaaagaaauau

SEQ ID NO: 5422 - RNA, 38 nt, Artificial Sequence
  Description of Artificial Sequence:  Enzymatic Nucleic Acid
  misc_feature (18)..(25): n stands for any nucleotide and can be optionally absent
aucccaaucugaugaggnnnnnnnnccgaaaagaaaua

SEQ ID NO: 5423 - RNA, 38 nt, Artificial Sequence
  Description of Artificial Sequence:  Enzymatic Nucleic Acid
  misc_feature (18)..(25): n stands for any nucleotide and can be optionally absent
caaauccccugaugaggnnnnnnnnccgaaauuaagaa

SEQ ID NO: 5424 - RNA, 38 nt, Artificial Sequence
  Description of Artificial Sequence:  Enzymatic Nucleic Acid
  misc_feature (18)..(25): n stands for any nucleotide and can be optionally absent
cgauuacacugaugaggnnnnnnnnccgaaaucccaau

SEQ ID NO: 5425 - RNA, 38 nt, Artificial Sequence
  Description of Artificial Sequence:  Enzymatic Nucleic Acid
  misc_feature (18)..(25): n stands for any nucleotide and can be optionally absent
acgauuaccugaugaggnnnnnnnnccgaaaaucccaa

SEQ ID NO: 5426 - RNA, 38 nt, Artificial Sequence
  Description of Artificial Sequence:  Enzymatic Nucleic Acid
  misc_feature (18)..(25): n stands for any nucleotide and can be optionally absent
gguacgaucugaugaggnnnnnnnnccgaaacaaaucc

SEQ ID NO: 5427 - RNA, 38 nt, Artificial Sequence
  Description of Artificial Sequence:  Enzymatic Nucleic Acid
  misc_feature (18)..(25): n stands for any nucleotide and can be optionally absent
guugguaccugaugaggnnnnnnnnccgaaauuacaaa

SEQ ID NO: 5428 - RNA, 38 nt, Artificial Sequence
  Description of Artificial Sequence:  Enzymatic Nucleic Acid
  misc_feature (18)..(25): n stands for any nucleotide and can be optionally absent
uaaguuggcugaugaggnnnnnnnnccgaaacgauuac

SEQ ID NO: 5429 - RNA, 38 nt, Artificial Sequence
  Description of Artificial Sequence:  Enzymatic Nucleic Acid
  misc_feature (18)..(25): n stands for any nucleotide and can be optionally absent
uaucaauucugaugaggnnnnnnnnccgaaaguuggua

SEQ ID NO: 5430 - RNA, 38 nt, Artificial Sequence
  Description of Artificial Sequence:  Enzymatic Nucleic Acid
  misc_feature (18)..(25): n stands for any nucleotide and can be optionally absent
uuaucaaucugaugaggnnnnnnnnccgaaaaguuggu

SEQ ID NO: 5431 - RNA, 38 nt, Artificial Sequence
  Description of Artificial Sequence:  Enzymatic Nucleic Acid
  misc_feature (18)..(25): n stands for any nucleotide and can be optionally absent
aguuuauccugaugaggnnnnnnnnccgaaauuaaguu

SEQ ID NO: 5432 - RNA, 38 nt, Artificial Sequence
  Description of Artificial Sequence:  Enzymatic Nucleic Acid
  misc_feature (18)..(25): n stands for any nucleotide and can be optionally absent
gccaaguucugaugaggnnnnnnnnccgaaaucaauua

SEQ ID NO: 5433 - RNA, 38 nt, Artificial Sequence
  Description of Artificial Sequence:  Enzymatic Nucleic Acid
  misc_feature (18)..(25): n stands for any nucleotide and can be optionally absent
caguugcccugaugaggnnnnnnnnccgaaaguuuauc

SEQ ID NO: 5434 - RNA, 38 nt, Artificial Sequence
  Description of Artificial Sequence:  Enzymatic Nucleic Acid
  misc_feature (18)..(25): n stands for any nucleotide and can be optionally absent
gaacauaacugaugaggnnnnnnnnccgaaagcaguug

SEQ ID NO: 5435 - RNA, 38 nt, Artificial Sequence
  Description of Artificial Sequence:  Enzymatic Nucleic Acid
  misc_feature (18)..(25): n stands for any nucleotide and can be optionally absent
agaacauacugaugaggnnnnnnnnccgaaaagcaguu

SEQ ID NO: 5436 - RNA, 38 nt, Artificial Sequence
  Description of Artificial Sequence:  Enzymatic Nucleic Acid
  misc_feature (18)..(25): n stands for any nucleotide and can be optionally absent
cagaacaucugaugaggnnnnnnnnccgaaaaagcagu

SEQ ID NO: 5437 - RNA, 38 nt, Artificial Sequence
  Description of Artificial Sequence:  Enzymatic Nucleic Acid
  misc_feature (18)..(25): n stands for any nucleotide and can be optionally absent
acagaacacugaugaggnnnnnnnnccgaaaaaagcag

SEQ ID NO: 5438 - RNA, 38 nt, Artificial Sequence
  Description of Artificial Sequence:  Enzymatic Nucleic Acid
  misc_feature (18)..(25): n stands for any nucleotide and can be optionally absent
ggagacagcugaugaggnnnnnnnnccgaaacauaaaa

SEQ ID NO: 5439 - RNA, 38 nt, Artificial Sequence
  Description of Artificial Sequence:  Enzymatic Nucleic Acid
  misc_feature (18)..(25): n stands for any nucleotide and can be optionally absent
aggagacacugaugaggnnnnnnnnccgaaaacauaaa

SEQ ID NO: 5440 - RNA, 38 nt, Artificial Sequence
  Description of Artificial Sequence:  Enzymatic Nucleic Acid
  misc_feature (18)..(25): n stands for any nucleotide and can be optionally absent
uggaaggacugaugaggnnnnnnnnccgaaacagaaca

SEQ ID NO: 5441 - RNA, 38 nt, Artificial Sequence
  Description of Artificial Sequence:  Enzymatic Nucleic Acid
  misc_feature (18)..(25): n stands for any nucleotide and can be optionally absent
uauggaagcugaugaggnnnnnnnnccgaaagacagaa

SEQ ID NO: 5442 - RNA, 38 nt, Artificial Sequence
  Description of Artificial Sequence:  Enzymatic Nucleic Acid
  misc_feature (18)..(25): n stands for any nucleotide and can be optionally absent
auuuauggcugaugaggnnnnnnnnccgaaaggagaca

SEQ ID NO: 5443 - RNA, 38 nt, Artificial Sequence
  Description of Artificial Sequence:  Enzymatic Nucleic Acid
  misc_feature (18)..(25): n stands for any nucleotide and can be optionally absent
aauuuaugcugaugaggnnnnnnnnccgaaaaggagac

SEQ ID NO: 5444 - RNA, 38 nt, Artificial Sequence
  Description of Artificial Sequence:  Enzymatic Nucleic Acid
  misc_feature (18)..(25): n stands for any nucleotide and can be optionally absent
gaaaaauucugaugaggnnnnnnnnccgaaauggaagg

SEQ ID NO: 5445 - RNA, 38 nt, Artificial Sequence
  Description of Artificial Sequence:  Enzymatic Nucleic Acid
  misc_feature (18)..(25): n stands for any nucleotide and can be optionally absent
uuuugaaacugaugaggnnnnnnnnccgaaauuuaugg

SEQ ID NO: 5446 - RNA, 38 nt, Artificial Sequence
  Description of Artificial Sequence:  Enzymatic Nucleic Acid
  misc_feature (18)..(25): n stands for any nucleotide and can be optionally absent
auuuugaacugaugaggnnnnnnnnccgaaaauuuaug

SEQ ID NO: 5447 - RNA, 38 nt, Artificial Sequence
  Description of Artificial Sequence:  Enzymatic Nucleic Acid
  misc_feature (18)..(25): n stands for any nucleotide and can be optionally absent
uauuuugacugaugaggnnnnnnnnccgaaaaauuuau

SEQ ID NO: 5448 - RNA, 38 nt, Artificial Sequence
  Description of Artificial Sequence:  Enzymatic Nucleic Acid
  misc_feature (18)..(25): n stands for any nucleotide and can be optionally absent
guauuuugcugaugaggnnnnnnnnccgaaaaaauuua

SEQ ID NO: 5449 - RNA, 38 nt, Artificial Sequence
  Description of Artificial Sequence:  Enzymatic Nucleic Acid
  misc_feature (18)..(25): n stands for any nucleotide and can be optionally absent
aguauuuucugaugaggnnnnnnnnccgaaaaaaauuu

SEQ ID NO: 5450 - RNA, 38 nt, Artificial Sequence
  Description of Artificial Sequence:  Enzymatic Nucleic Acid
  misc_feature (18)..(25): n stands for any nucleotide and can be optionally absent
ugaauuagcugaugaggnnnnnnnnccgaaauuuugaa

SEQ ID NO: 5451 - RNA, 38 nt, Artificial Sequence
  Description of Artificial Sequence:  Enzymatic Nucleic Acid
  misc_feature (18)..(25): n stands for any nucleotide and can be optionally absent
uguugaaucugaugaggnnnnnnnnccgaaaguauuuu

SEQ ID NO: 5452 - RNA, 38 nt, Artificial Sequence
  Description of Artificial Sequence:  Enzymatic Nucleic Acid
  misc_feature (18)..(25): n stands for any nucleotide and can be optionally absent
cuuuguugcugaugaggnnnnnnnnccgaaauuaguau

SEQ ID NO: 5453 - RNA, 38 nt, Artificial Sequence
  Description of Artificial Sequence:  Enzymatic Nucleic Acid
  misc_feature (18)..(25): n stands for any nucleotide and can be optionally absent
ucuuuguucugaugaggnnnnnnnnccgaaaauuagua

SEQ ID NO: 5454 - RNA, 38 nt, Artificial Sequence
  Description of Artificial Sequence:  Enzymatic Nucleic Acid
  misc_feature (18)..(25): n stands for any nucleotide and can be optionally absent
aaaaaaaacugaugaggnnnnnnnnccgaaagcuuuuu

SEQ ID NO: 5455 - RNA, 38 nt, Artificial Sequence
  Description of Artificial Sequence:  Enzymatic Nucleic Acid
  misc_feature (18)..(25): n stands for any nucleotide and can be optionally absent
ggaaaaaacugaugaggnnnnnnnnccgaaagagcuuu

SEQ ID NO: 5456 - RNA, 38 nt, Artificial Sequence
  Description of Artificial Sequence:  Enzymatic Nucleic Acid
  misc_feature (18)..(25): n stands for any nucleotide and can be optionally absent
aggaaaaacugaugaggnnnnnnnnccgaaaagagcuu

SEQ ID NO: 5457 - RNA, 38 nt, Artificial Sequence
  Description of Artificial Sequence:  Enzymatic Nucleic Acid
  misc_feature (18)..(25): n stands for any nucleotide and can be optionally absent
uaggaaaacugaugaggnnnnnnnnccgaaaaagagcu

SEQ ID NO: 5458 - RNA, 38 nt, Artificial Sequence
  Description of Artificial Sequence:  Enzymatic Nucleic Acid
  misc_feature (18)..(25): n stands for any nucleotide and can be optionally absent
uuaggaaacugaugaggnnnnnnnnccgaaaaaagagc

SEQ ID NO: 5459 - RNA, 38 nt, Artificial Sequence
  Description of Artificial Sequence:  Enzymatic Nucleic Acid
  misc_feature (18)..(25): n stands for any nucleotide and can be optionally absent
uuuaggaacugaugaggnnnnnnnnccgaaaaaaagag

SEQ ID NO: 5460 - RNA, 38 nt, Artificial Sequence
  Description of Artificial Sequence:  Enzymatic Nucleic Acid
  misc_feature (18)..(25): n stands for any nucleotide and can be optionally absent
uuuuaggacugaugaggnnnnnnnnccgaaaaaaaaga

SEQ ID NO: 5461 - RNA, 38 nt, Artificial Sequence
  Description of Artificial Sequence:  Enzymatic Nucleic Acid
  misc_feature (18)..(25): n stands for any nucleotide and can be optionally absent
auuuuaggcugaugaggnnnnnnnnccgaaaaaaaaag

SEQ ID NO: 5462 - RNA, 38 nt, Artificial Sequence
  Description of Artificial Sequence:  Enzymatic Nucleic Acid
  misc_feature (18)..(25): n stands for any nucleotide and can be optionally absent
uauuuuagcugaugaggnnnnnnnnccgaaaaaaaaaa

SEQ ID NO: 5463 - RNA, 38 nt, Artificial Sequence
  Description of Artificial Sequence:  Enzymatic Nucleic Acid
  misc_feature (18)..(25): n stands for any nucleotide and can be optionally absent
guuuauuucugaugaggnnnnnnnnccgaaaggaaaaa

SEQ ID NO: 5464 - RNA, 38 nt, Artificial Sequence
  Description of Artificial Sequence:  Enzymatic Nucleic Acid
  misc_feature (18)..(25): n stands for any nucleotide and can be optionally absent
uuugaguucugaugaggnnnnnnnnccgaaauuuuagg

SEQ ID NO: 5465 - RNA, 38 nt, Artificial Sequence
  Description of Artificial Sequence:  Enzymatic Nucleic Acid
  misc_feature (18)..(25): n stands for any nucleotide and can be optionally absent
auaaauuucugaugaggnnnnnnnnccgaaaguuuauu

SEQ ID NO: 5466 - RNA, 38 nt, Artificial Sequence
  Description of Artificial Sequence:  Enzymatic Nucleic Acid
  misc_feature (18)..(25): n stands for any nucleotide and can be optionally absent
caaggauacugaugaggnnnnnnnnccgaaauuugagu

SEQ ID NO: 5467 - RNA, 38 nt, Artificial Sequence
  Description of Artificial Sequence:  Enzymatic Nucleic Acid
  misc_feature (18)..(25): n stands for any nucleotide and can be optionally absent
acaaggaucugaugaggnnnnnnnnccgaaaauuugag

SEQ ID NO: 5468 - RNA, 38 nt, Artificial Sequence
  Description of Artificial Sequence:  Enzymatic Nucleic Acid
  misc_feature (18)..(25): n stands for any nucleotide and can be optionally absent
aacaaggacugaugaggnnnnnnnnccgaaaaauuuga

SEQ ID NO: 5469 - RNA, 38 nt, Artificial Sequence
  Description of Artificial Sequence:  Enzymatic Nucleic Acid
  misc_feature (18)..(25): n stands for any nucleotide and can be optionally absent
uaaacaagcugaugaggnnnnnnnnccgaaauaaauuu

SEQ ID NO: 5470 - RNA, 38 nt, Artificial Sequence
  Description of Artificial Sequence:  Enzymatic Nucleic Acid
  misc_feature (18)..(25): n stands for any nucleotide and can be optionally absent
cucuaaaccugaugaggnnnnnnnnccgaaaggauaaa

SEQ ID NO: 5471 - RNA, 38 nt, Artificial Sequence
  Description of Artificial Sequence:  Enzymatic Nucleic Acid
  misc_feature (18)..(25): n stands for any nucleotide and can be optionally absent
cugcucuacugaugaggnnnnnnnnccgaaacaaggau

SEQ ID NO: 5472 - RNA, 38 nt, Artificial Sequence
  Description of Artificial Sequence:  Enzymatic Nucleic Acid
  misc_feature (18)..(25): n stands for any nucleotide and can be optionally absent
ucugcucucugaugaggnnnnnnnnccgaaaacaagga

SEQ ID NO: 5473 - RNA, 38 nt, Artificial Sequence
  Description of Artificial Sequence:  Enzymatic Nucleic Acid
  misc_feature (18)..(25): n stands for any nucleotide and can be optionally absent
cucugcuccugaugaggnnnnnnnnccgaaaaacaagg

SEQ ID NO: 5474 - RNA, 38 nt, Artificial Sequence
  Description of Artificial Sequence:  Enzymatic Nucleic Acid
  misc_feature (18)..(25): n stands for any nucleotide and can be optionally absent
uuuuucuucugaugaggnnnnnnnnccgaaauuuuucu

SEQ ID NO: 5475 - RNA, 38 nt, Artificial Sequence
  Description of Artificial Sequence:  Enzymatic Nucleic Acid
  misc_feature (18)..(25): n stands for any nucleotide and can be optionally absent
guuuuucucugaugaggnnnnnnnnccgaaaauuuuuc

SEQ ID NO: 5476 - RNA, 38 nt, Artificial Sequence
  Description of Artificial Sequence:  Enzymatic Nucleic Acid
  misc_feature (18)..(25): n stands for any nucleotide and can be optionally absent
ccauuucacugaugaggnnnnnnnnccgaaaguuuuuc

SEQ ID NO: 5477 - RNA, 38 nt, Artificial Sequence
  Description of Artificial Sequence:  Enzymatic Nucleic Acid
  misc_feature (18)..(25): n stands for any nucleotide and can be optionally absent
accauuuccugaugaggnnnnnnnnccgaaaaguuuuu

SEQ ID NO: 5478 - RNA, 38 nt, Artificial Sequence
  Description of Artificial Sequence:  Enzymatic Nucleic Acid
  misc_feature (18)..(25): n stands for any nucleotide and can be optionally absent
uuuuuugacugaugaggnnnnnnnnccgaaaccauuuc

SEQ ID NO: 5479 - RNA, 38 nt, Artificial Sequence
  Description of Artificial Sequence:  Enzymatic Nucleic Acid
  misc_feature (18)..(25): n stands for any nucleotide and can be optionally absent
aauuuuuucugaugaggnnnnnnnnccgaaagaccauu

SEQ ID NO: 5480 - RNA, 38 nt, Artificial Sequence
  Description of Artificial Sequence:  Enzymatic Nucleic Acid
  misc_feature (18)..(25): n stands for any nucleotide and can be optionally absent
uauuuagccugaugaggnnnnnnnnccgaaauuuuuug

SEQ ID NO: 5481 - RNA, 38 nt, Artificial Sequence
  Description of Artificial Sequence:  Enzymatic Nucleic Acid
  misc_feature (18)..(25): n stands for any nucleotide and can be optionally absent
aaaauauucugaugaggnnnnnnnnccgaaagcaauuu

SEQ ID NO: 5482 - RNA, 38 nt, Artificial Sequence
  Description of Artificial Sequence:  Enzymatic Nucleic Acid
  misc_feature (18)..(25): n stands for any nucleotide and can be optionally absent
auugaaaacugaugaggnnnnnnnnccgaaauuuagca

SEQ ID NO: 5483 - RNA, 38 nt, Artificial Sequence
  Description of Artificial Sequence:  Enzymatic Nucleic Acid
  misc_feature (18)..(25): n stands for any nucleotide and can be optionally absent
ccauugaacugaugaggnnnnnnnnccgaaauauuuag

SEQ ID NO: 5484 - RNA, 38 nt, Artificial Sequence
  Description of Artificial Sequence:  Enzymatic Nucleic Acid
  misc_feature (18)..(25): n stands for any nucleotide and can be optionally absent
uccauugacugaugaggnnnnnnnnccgaaaauauuua

SEQ ID NO: 5485 - RNA, 38 nt, Artificial Sequence
  Description of Artificial Sequence:  Enzymatic Nucleic Acid
  misc_feature (18)..(25): n stands for any nucleotide and can be optionally absent
uuccauugcugaugaggnnnnnnnnccgaaaaauauuu

SEQ ID NO: 5486 - RNA, 38 nt, Artificial Sequence
  Description of Artificial Sequence:  Enzymatic Nucleic Acid
  misc_feature (18)..(25): n stands for any nucleotide and can be optionally absent
uuuccauucugaugaggnnnnnnnnccgaaaaaauauu

SEQ ID NO: 5487 - RNA, 38 nt, Artificial Sequence
  Description of Artificial Sequence:  Enzymatic Nucleic Acid
  misc_feature (18)..(25): n stands for any nucleotide and can be optionally absent
cuaacauucugaugaggnnnnnnnnccgaaaguuuucc

SEQ ID NO: 5488 - RNA, 38 nt, Artificial Sequence
  Description of Artificial Sequence:  Enzymatic Nucleic Acid
  misc_feature (18)..(25): n stands for any nucleotide and can be optionally absent
gcuaaacucugaugaggnnnnnnnnccgaaacauuuag

SEQ ID NO: 5489 - RNA, 38 nt, Artificial Sequence
  Description of Artificial Sequence:  Enzymatic Nucleic Acid
  misc_feature (18)..(25): n stands for any nucleotide and can be optionally absent
agcuaaaccugaugaggnnnnnnnnccgaaaacauuua

SEQ ID NO: 5490 - RNA, 38 nt, Artificial Sequence
  Description of Artificial Sequence:  Enzymatic Nucleic Acid
  misc_feature (18)..(25): n stands for any nucleotide and can be optionally absent
aucagcuacugaugaggnnnnnnnnccgaaacuaacau

SEQ ID NO: 5491 - RNA, 38 nt, Artificial Sequence
  Description of Artificial Sequence:  Enzymatic Nucleic Acid
  misc_feature (18)..(25): n stands for any nucleotide and can be optionally absent
aaucagcucugaugaggnnnnnnnnccgaaaacuaaca

SEQ ID NO: 5492 - RNA, 38 nt, Artificial Sequence
  Description of Artificial Sequence:  Enzymatic Nucleic Acid
  misc_feature (18)..(25): n stands for any nucleotide and can be optionally absent
caaucagccugaugaggnnnnnnnnccgaaaaacuaac

SEQ ID NO: 5493 - RNA, 38 nt, Artificial Sequence
  Description of Artificial Sequence:  Enzymatic Nucleic Acid
  misc_feature (18)..(25): n stands for any nucleotide and can be optionally absent
ccccauaccugaugaggnnnnnnnnccgaaaucagcua

SEQ ID NO: 5494 - RNA, 38 nt, Artificial Sequence
  Description of Artificial Sequence:  Enzymatic Nucleic Acid
  misc_feature (18)..(25): n stands for any nucleotide and can be optionally absent
aaaccccacugaugaggnnnnnnnnccgaaacaaucag

SEQ ID NO: 5495 - RNA, 38 nt, Artificial Sequence
  Description of Artificial Sequence:  Enzymatic Nucleic Acid
  misc_feature (18)..(25): n stands for any nucleotide and can be optionally absent
gguucgaacugaugaggnnnnnnnnccgaaaccccaua

SEQ ID NO: 5496 - RNA, 38 nt, Artificial Sequence
  Description of Artificial Sequence:  Enzymatic Nucleic Acid
  misc_feature (18)..(25): n stands for any nucleotide and can be optionally absent
agguucgacugaugaggnnnnnnnnccgaaaaccccau

SEQ ID NO: 5497 - RNA, 38 nt, Artificial Sequence
  Description of Artificial Sequence:  Enzymatic Nucleic Acid
  misc_feature (18)..(25): n stands for any nucleotide and can be optionally absent
aagguucgcugaugaggnnnnnnnnccgaaaaacccca

SEQ ID NO: 5498 - RNA, 38 nt, Artificial Sequence
  Description of Artificial Sequence:  Enzymatic Nucleic Acid
  misc_feature (18)..(25): n stands for any nucleotide and can be optionally absent
aaagguuccugaugaggnnnnnnnnccgaaaaaacccc

SEQ ID NO: 5499 - RNA, 38 nt, Artificial Sequence
  Description of Artificial Sequence:  Enzymatic Nucleic Acid
  misc_feature (18)..(25): n stands for any nucleotide and can be optionally absent
aaaagugacugaugaggnnnnnnnnccgaaagguucga

SEQ ID NO: 5500 - RNA, 38 nt, Artificial Sequence
  Description of Artificial Sequence:  Enzymatic Nucleic Acid
  misc_feature (18)..(25): n stands for any nucleotide and can be optionally absent
aaaaagugcugaugaggnnnnnnnnccgaaaagguucg

SEQ ID NO: 5501 - RNA, 38 nt, Artificial Sequence
  Description of Artificial Sequence:  Enzymatic Nucleic Acid
  misc_feature (18)..(25): n stands for any nucleotide and can be optionally absent
caaaaagucugaugaggnnnnnnnnccgaaaaagguuc

SEQ ID NO: 5502 - RNA, 38 nt, Artificial Sequence
  Description of Artificial Sequence:  Enzymatic Nucleic Acid
  misc_feature (18)..(25): n stands for any nucleotide and can be optionally absent
caaacaaacugaugaggnnnnnnnnccgaaagugaaag

SEQ ID NO: 5503 - RNA, 38 nt, Artificial Sequence
  Description of Artificial Sequence:  Enzymatic Nucleic Acid
  misc_feature (18)..(25): n stands for any nucleotide and can be optionally absent
acaaacaacugaugaggnnnnnnnnccgaaaagugaaa

SEQ ID NO: 5504 - RNA, 38 nt, Artificial Sequence
  Description of Artificial Sequence:  Enzymatic Nucleic Acid
  misc_feature (18)..(25): n stands for any nucleotide and can be optionally absent
aacaaacacugaugaggnnnnnnnnccgaaaaagugaa

SEQ ID NO: 5505 - RNA, 38 nt, Artificial Sequence
  Description of Artificial Sequence:  Enzymatic Nucleic Acid
  misc_feature (18)..(25): n stands for any nucleotide and can be optionally absent
aaacaaaccugaugaggnnnnnnnnccgaaaaaaguga

SEQ ID NO: 5506 - RNA, 38 nt, Artificial Sequence
  Description of Artificial Sequence:  Enzymatic Nucleic Acid
  misc_feature (18)..(25): n stands for any nucleotide and can be optionally absent
guaaaacacugaugaggnnnnnnnnccgaaacaaaaag

SEQ ID NO: 5507 - RNA, 38 nt, Artificial Sequence
  Description of Artificial Sequence:  Enzymatic Nucleic Acid
  misc_feature (18)..(25): n stands for any nucleotide and can be optionally absent
gguaaaaccugaugaggnnnnnnnnccgaaaacaaaaa

SEQ ID NO: 5508 - RNA, 38 nt, Artificial Sequence
  Description of Artificial Sequence:  Enzymatic Nucleic Acid
  misc_feature (18)..(25): n stands for any nucleotide and can be optionally absent
auagguaacugaugaggnnnnnnnnccgaaacaaacaa

SEQ ID NO: 5509 - RNA, 38 nt, Artificial Sequence
  Description of Artificial Sequence:  Enzymatic Nucleic Acid
  misc_feature (18)..(25): n stands for any nucleotide and can be optionally absent
aauagguacugaugaggnnnnnnnnccgaaaacaaaca

SEQ ID NO: 5510 - RNA, 38 nt, Artificial Sequence
  Description of Artificial Sequence:  Enzymatic Nucleic Acid
  misc_feature (18)..(25): n stands for any nucleotide and can be optionally absent
aaauaggucugaugaggnnnnnnnnccgaaaaacaaac

SEQ ID NO: 5511 - RNA, 38 nt, Artificial Sequence
  Description of Artificial Sequence:  Enzymatic Nucleic Acid
  misc_feature (18)..(25): n stands for any nucleotide and can be optionally absent
gaaauaggcugaugaggnnnnnnnnccgaaaaaacaaa

SEQ ID NO: 5512 - RNA, 38 nt, Artificial Sequence
  Description of Artificial Sequence:  Enzymatic Nucleic Acid
  misc_feature (18)..(25): n stands for any nucleotide and can be optionally absent
uugugaaacugaugaggnnnnnnnnccgaaagguaaaa

SEQ ID NO: 5513 - RNA, 38 nt, Artificial Sequence
  Description of Artificial Sequence:  Enzymatic Nucleic Acid
  misc_feature (18)..(25): n stands for any nucleotide and can be optionally absent
aguugugacugaugaggnnnnnnnnccgaaauagguaa

SEQ ID NO: 5514 - RNA, 38 nt, Artificial Sequence
  Description of Artificial Sequence:  Enzymatic Nucleic Acid
  misc_feature (18)..(25): n stands for any nucleotide and can be optionally absent
caguugugcugaugaggnnnnnnnnccgaaaauaggua

SEQ ID NO: 5515 - RNA, 38 nt, Artificial Sequence
  Description of Artificial Sequence:  Enzymatic Nucleic Acid
  misc_feature (18)..(25): n stands for any nucleotide and can be optionally absent
acaguugucugaugaggnnnnnnnnccgaaaaauaggu

SEQ ID NO: 5516 - RNA, 38 nt, Artificial Sequence
  Description of Artificial Sequence:  Enzymatic Nucleic Acid
  misc_feature (18)..(25): n stands for any nucleotide and can be optionally absent
uggcaauucugaugaggnnnnnnnnccgaaacacaguu

SEQ ID NO: 5517 - RNA, 38 nt, Artificial Sequence
  Description of Artificial Sequence:  Enzymatic Nucleic Acid
  misc_feature (18)..(25): n stands for any nucleotide and can be optionally absent
uuauuggccugaugaggnnnnnnnnccgaaauuuacac

SEQ ID NO: 5518 - RNA, 38 nt, Artificial Sequence
  Description of Artificial Sequence:  Enzymatic Nucleic Acid
  misc_feature (18)..(25): n stands for any nucleotide and can be optionally absent
acaggaaucugaugaggnnnnnnnnccgaaauuggcaa

SEQ ID NO: 5519 - RNA, 38 nt, Artificial Sequence
  Description of Artificial Sequence:  Enzymatic Nucleic Acid
  misc_feature (18)..(25): n stands for any nucleotide and can be optionally absent
uggacaggcugaugaggnnnnnnnnccgaaauuauugg

SEQ ID NO: 5520 - RNA, 38 nt, Artificial Sequence
  Description of Artificial Sequence:  Enzymatic Nucleic Acid
  misc_feature (18)..(25): n stands for any nucleotide and can be optionally absent
auggacagcugaugaggnnnnnnnnccgaaaauuauug

SEQ ID NO: 5521 - RNA, 38 nt, Artificial Sequence
  Description of Artificial Sequence:  Enzymatic Nucleic Acid
  misc_feature (18)..(25): n stands for any nucleotide and can be optionally absent
uuuucaugcugaugaggnnnnnnnnccgaaacaggaau

SEQ ID NO: 5522 - RNA, 38 nt, Artificial Sequence
  Description of Artificial Sequence:  Enzymatic Nucleic Acid
  misc_feature (18)..(25): n stands for any nucleotide and can be optionally absent
cacuggaucugaugaggnnnnnnnnccgaaauuugcau

SEQ ID NO: 5523 - RNA, 38 nt, Artificial Sequence
  Description of Artificial Sequence:  Enzymatic Nucleic Acid
  misc_feature (18)..(25): n stands for any nucleotide and can be optionally absent
acacuggacugaugaggnnnnnnnnccgaaaauuugca

SEQ ID NO: 5524 - RNA, 38 nt, Artificial Sequence
  Description of Artificial Sequence:  Enzymatic Nucleic Acid
  misc_feature (18)..(25): n stands for any nucleotide and can be optionally absent
cuacacugcugaugaggnnnnnnnnccgaaauaauuug

SEQ ID NO: 5525 - RNA, 38 nt, Artificial Sequence
  Description of Artificial Sequence:  Enzymatic Nucleic Acid
  misc_feature (18)..(25): n stands for any nucleotide and can be optionally absent
aauauauccugaugaggnnnnnnnnccgaaacacugga

SEQ ID NO: 5526 - RNA, 38 nt, Artificial Sequence
  Description of Artificial Sequence:  Enzymatic Nucleic Acid
  misc_feature (18)..(25): n stands for any nucleotide and can be optionally absent
gucaaauacugaugaggnnnnnnnnccgaaaucuacac

SEQ ID NO: 5527 - RNA, 38 nt, Artificial Sequence
  Description of Artificial Sequence:  Enzymatic Nucleic Acid
  misc_feature (18)..(25): n stands for any nucleotide and can be optionally absent
uggucaaacugaugaggnnnnnnnnccgaaauaucuac

SEQ ID NO: 5528 - RNA, 38 nt, Artificial Sequence
  Description of Artificial Sequence:  Enzymatic Nucleic Acid
  misc_feature (18)..(25): n stands for any nucleotide and can be optionally absent
gauggucacugaugaggnnnnnnnnccgaaauauaucu

SEQ ID NO: 5529 - RNA, 38 nt, Artificial Sequence
  Description of Artificial Sequence:  Enzymatic Nucleic Acid
  misc_feature (18)..(25): n stands for any nucleotide and can be optionally absent
ugaugguccugaugaggnnnnnnnnccgaaaauauauc

SEQ ID NO: 5530 - RNA, 38 nt, Artificial Sequence
  Description of Artificial Sequence:  Enzymatic Nucleic Acid
  misc_feature (18)..(25): n stands for any nucleotide and can be optionally absent
cauagggucugaugaggnnnnnnnnccgaaauggucaa

SEQ ID NO: 5531 - RNA, 38 nt, Artificial Sequence
  Description of Artificial Sequence:  Enzymatic Nucleic Acid
  misc_feature (18)..(25): n stands for any nucleotide and can be optionally absent
aauauccacugaugaggnnnnnnnnccgaaagggugau

SEQ ID NO: 5532 - RNA, 38 nt, Artificial Sequence
  Description of Artificial Sequence:  Enzymatic Nucleic Acid
  misc_feature (18)..(25): n stands for any nucleotide and can be optionally absent
cuagccaacugaugaggnnnnnnnnccgaaauccauag

SEQ ID NO: 5533 - RNA, 38 nt, Artificial Sequence
  Description of Artificial Sequence:  Enzymatic Nucleic Acid
  misc_feature (18)..(25): n stands for any nucleotide and can be optionally absent
aacuagcccugaugaggnnnnnnnnccgaaauauccau

SEQ ID NO: 5534 - RNA, 38 nt, Artificial Sequence
  Description of Artificial Sequence:  Enzymatic Nucleic Acid
  misc_feature (18)..(25): n stands for any nucleotide and can be optionally absent
ggcaaaaccugaugaggnnnnnnnnccgaaagccaaua

SEQ ID NO: 5535 - RNA, 38 nt, Artificial Sequence
  Description of Artificial Sequence:  Enzymatic Nucleic Acid
  misc_feature (18)..(25): n stands for any nucleotide and can be optionally absent
aaaggcaacugaugaggnnnnnnnnccgaaacuagcca

SEQ ID NO: 5536 - RNA, 38 nt, Artificial Sequence
  Description of Artificial Sequence:  Enzymatic Nucleic Acid
  misc_feature (18)..(25): n stands for any nucleotide and can be optionally absent
uaaaggcacugaugaggnnnnnnnnccgaaaacuagcc

SEQ ID NO: 5537 - RNA, 38 nt, Artificial Sequence
  Description of Artificial Sequence:  Enzymatic Nucleic Acid
  misc_feature (18)..(25): n stands for any nucleotide and can be optionally absent
auaaaggccugaugaggnnnnnnnnccgaaaaacuagc

SEQ ID NO: 5538 - RNA, 38 nt, Artificial Sequence
  Description of Artificial Sequence:  Enzymatic Nucleic Acid
  misc_feature (18)..(25): n stands for any nucleotide and can be optionally absent
gcuuaauacugaugaggnnnnnnnnccgaaaggcaaaa

SEQ ID NO: 5539 - RNA, 38 nt, Artificial Sequence
  Description of Artificial Sequence:  Enzymatic Nucleic Acid
  misc_feature (18)..(25): n stands for any nucleotide and can be optionally absent
ugcuuaaucugaugaggnnnnnnnnccgaaaaggcaaa

SEQ ID NO: 5540 - RNA, 38 nt, Artificial Sequence
  Description of Artificial Sequence:  Enzymatic Nucleic Acid
  misc_feature (18)..(25): n stands for any nucleotide and can be optionally absent
uugcuuaacugaugaggnnnnnnnnccgaaaaaggcaa

SEQ ID NO: 5541 - RNA, 38 nt, Artificial Sequence
  Description of Artificial Sequence:  Enzymatic Nucleic Acid
  misc_feature (18)..(25): n stands for any nucleotide and can be optionally absent
auuugcuucugaugaggnnnnnnnnccgaaauaaaggc

SEQ ID NO: 5542 - RNA, 38 nt, Artificial Sequence
  Description of Artificial Sequence:  Enzymatic Nucleic Acid
  misc_feature (18)..(25): n stands for any nucleotide and can be optionally absent
aauuugcucugaugaggnnnnnnnnccgaaaauaaagg

SEQ ID NO: 5543 - RNA, 38 nt, Artificial Sequence
  Description of Artificial Sequence:  Enzymatic Nucleic Acid
  misc_feature (18)..(25): n stands for any nucleotide and can be optionally absent
cugaaaugcugaugaggnnnnnnnnccgaaauuugcuu

SEQ ID NO: 5544 - RNA, 38 nt, Artificial Sequence
  Description of Artificial Sequence:  Enzymatic Nucleic Acid
  misc_feature (18)..(25): n stands for any nucleotide and can be optionally absent
gcugaaaucugaugaggnnnnnnnnccgaaaauuugcu

SEQ ID NO: 5545 - RNA, 38 nt, Artificial Sequence
  Description of Artificial Sequence:  Enzymatic Nucleic Acid
  misc_feature (18)..(25): n stands for any nucleotide and can be optionally absent
caggcugacugaugaggnnnnnnnnccgaaaugaauuu

SEQ ID NO: 5546 - RNA, 38 nt, Artificial Sequence
  Description of Artificial Sequence:  Enzymatic Nucleic Acid
  misc_feature (18)..(25): n stands for any nucleotide and can be optionally absent
ucaggcugcugaugaggnnnnnnnnccgaaaaugaauu

SEQ ID NO: 5547 - RNA, 38 nt, Artificial Sequence
  Description of Artificial Sequence:  Enzymatic Nucleic Acid
  misc_feature (18)..(25): n stands for any nucleotide and can be optionally absent
uucaggcucugaugaggnnnnnnnnccgaaaaaugaau

SEQ ID NO: 5548 - RNA, 38 nt, Artificial Sequence
  Description of Artificial Sequence:  Enzymatic Nucleic Acid
  misc_feature (18)..(25): n stands for any nucleotide and can be optionally absent
uauaggcacugaugaggnnnnnnnnccgaaacauucag

SEQ ID NO: 5549 - RNA, 38 nt, Artificial Sequence
  Description of Artificial Sequence:  Enzymatic Nucleic Acid
  misc_feature (18)..(25): n stands for any nucleotide and can be optionally absent
agaauauacugaugaggnnnnnnnnccgaaaggcagac

SEQ ID NO: 5550 - RNA, 38 nt, Artificial Sequence
  Description of Artificial Sequence:  Enzymatic Nucleic Acid
  misc_feature (18)..(25): n stands for any nucleotide and can be optionally absent
agagaauacugaugaggnnnnnnnnccgaaauaggcag

SEQ ID NO: 5551 - RNA, 38 nt, Artificial Sequence
  Description of Artificial Sequence:  Enzymatic Nucleic Acid
  misc_feature (18)..(25): n stands for any nucleotide and can be optionally absent
gcagagaacugaugaggnnnnnnnnccgaaauauaggc

SEQ ID NO: 5552 - RNA, 38 nt, Artificial Sequence
  Description of Artificial Sequence:  Enzymatic Nucleic Acid
  misc_feature (18)..(25): n stands for any nucleotide and can be optionally absent
gagcagagcugaugaggnnnnnnnnccgaaauauauag

SEQ ID NO: 5553 - RNA, 38 nt, Artificial Sequence
  Description of Artificial Sequence:  Enzymatic Nucleic Acid
  misc_feature (18)..(25): n stands for any nucleotide and can be optionally absent
agagcagacugaugaggnnnnnnnnccgaaaauauaua

SEQ ID NO: 5554 - RNA, 38 nt, Artificial Sequence
  Description of Artificial Sequence:  Enzymatic Nucleic Acid
  misc_feature (18)..(25): n stands for any nucleotide and can be optionally absent
aaagagcacugaugaggnnnnnnnnccgaaagaauaua

SEQ ID NO: 5555 - RNA, 38 nt, Artificial Sequence
  Description of Artificial Sequence:  Enzymatic Nucleic Acid
  misc_feature (18)..(25): n stands for any nucleotide and can be optionally absent
aauacaaacugaugaggnnnnnnnnccgaaagcagaga

SEQ ID NO: 5556 - RNA, 38 nt, Artificial Sequence
  Description of Artificial Sequence:  Enzymatic Nucleic Acid
  misc_feature (18)..(25): n stands for any nucleotide and can be optionally absent
agaauacacugaugaggnnnnnnnnccgaaagagcaga

SEQ ID NO: 5557 - RNA, 38 nt, Artificial Sequence
  Description of Artificial Sequence:  Enzymatic Nucleic Acid
  misc_feature (18)..(25): n stands for any nucleotide and can be optionally absent
gagaauaccugaugaggnnnnnnnnccgaaaagagcag

SEQ ID NO: 5558 - RNA, 38 nt, Artificial Sequence
  Description of Artificial Sequence:  Enzymatic Nucleic Acid
  misc_feature (18)..(25): n stands for any nucleotide and can be optionally absent
aaggagaacugaugaggnnnnnnnnccgaaacaaagag

SEQ ID NO: 5559 - RNA, 38 nt, Artificial Sequence
  Description of Artificial Sequence:  Enzymatic Nucleic Acid
  misc_feature (18)..(25): n stands for any nucleotide and can be optionally absent
caaaggagcugaugaggnnnnnnnnccgaaauacaaag

SEQ ID NO: 5560 - RNA, 38 nt, Artificial Sequence
  Description of Artificial Sequence:  Enzymatic Nucleic Acid
  misc_feature (18)..(25): n stands for any nucleotide and can be optionally absent
ucaaaggacugaugaggnnnnnnnnccgaaaauacaaa

SEQ ID NO: 5561 - RNA, 38 nt, Artificial Sequence
  Description of Artificial Sequence:  Enzymatic Nucleic Acid
  misc_feature (18)..(25): n stands for any nucleotide and can be optionally absent
guucaaagcugaugaggnnnnnnnnccgaaagaauaca

SEQ ID NO: 5562 - RNA, 38 nt, Artificial Sequence
  Description of Artificial Sequence:  Enzymatic Nucleic Acid
  misc_feature (18)..(25): n stands for any nucleotide and can be optionally absent
cggguucacugaugaggnnnnnnnnccgaaaggagaau

SEQ ID NO: 5563 - RNA, 38 nt, Artificial Sequence
  Description of Artificial Sequence:  Enzymatic Nucleic Acid
  misc_feature (18)..(25): n stands for any nucleotide and can be optionally absent
acggguuccugaugaggnnnnnnnnccgaaaaggagaa

SEQ ID NO: 5564 - RNA, 38 nt, Artificial Sequence
  Description of Artificial Sequence:  Enzymatic Nucleic Acid
  misc_feature (18)..(25): n stands for any nucleotide and can be optionally absent
gauguuuucugaugaggnnnnnnnnccgaaacggguuc

SEQ ID NO: 5565 - RNA, 38 nt, Artificial Sequence
  Description of Artificial Sequence:  Enzymatic Nucleic Acid
  misc_feature (18)..(25): n stands for any nucleotide and can be optionally absent
ggauguuucugaugaggnnnnnnnnccgaaaacggguu

SEQ ID NO: 5566 - RNA, 38 nt, Artificial Sequence
  Description of Artificial Sequence:  Enzymatic Nucleic Acid
  misc_feature (18)..(25): n stands for any nucleotide and can be optionally absent
ugccacagcugaugaggnnnnnnnnccgaaauguuuua

SEQ ID NO: 5567 - RNA, 54 nt, Artificial Sequence
  Description of Artificial Sequence:  Enzymatic Nucleic Acid
  misc_feature (18)..(25): n stands for any nucleotide and can be optionally absent
cggggaggagaagagaggaccagagaaacacacguugugguacauuaccuggua

SEQ ID NO: 5568 - RNA, 54 nt, Artificial Sequence
  Description of Artificial Sequence:  Enzymatic Nucleic Acid
  misc_feature (18)..(25): n stands for any nucleotide and can be optionally absent
ccgcuccgagaagccgccaccagagaaacacacguugugguacauuaccuggua

SEQ ID NO: 5569 - RNA, 54 nt, Artificial Sequence
  Description of Artificial Sequence:  Enzymatic Nucleic Acid
  misc_feature (18)..(25): n stands for any nucleotide and can be optionally absent
ccgccagaagaaguccucaccagagaaacacacguugugguacauuaccuggua

SEQ ID NO: 5570 - RNA, 54 nt, Artificial Sequence
  Description of Artificial Sequence:  Enzymatic Nucleic Acid
  misc_feature (18)..(25): n stands for any nucleotide and can be optionally absent
aacgacccagaagccagaaccagagaaacacacguugugguacauuaccuggua

SEQ ID NO: 5571 - RNA, 54 nt, Artificial Sequence
  Description of Artificial Sequence:  Enzymatic Nucleic Acid
  misc_feature (18)..(25): n stands for any nucleotide and can be optionally absent
gcgcgcacagaaggacccaccagagaaacacacguugugguacauuaccuggua

SEQ ID NO: 5572 - RNA, 54 nt, Artificial Sequence
  Description of Artificial Sequence:  Enzymatic Nucleic Acid
  misc_feature (18)..(25): n stands for any nucleotide and can be optionally absent
gacagcugagaagcgcgcaccagagaaacacacguugugguacauuaccuggua

SEQ ID NO: 5573 - RNA, 54 nt, Artificial Sequence
  Description of Artificial Sequence:  Enzymatic Nucleic Acid
  misc_feature (18)..(25): n stands for any nucleotide and can be optionally absent
aagcagacagaagagcagaccagagaaacacacguugugguacauuaccuggua

SEQ ID NO: 5574 - RNA, 54 nt, Artificial Sequence
  Description of Artificial Sequence:  Enzymatic Nucleic Acid
  misc_feature (18)..(25): n stands for any nucleotide and can be optionally absent
gagaagcaagaagcugagaccagagaaacacacguugugguacauuaccuggua

SEQ ID NO: 5575 - RNA, 54 nt, Artificial Sequence
  Description of Artificial Sequence:  Enzymatic Nucleic Acid
  misc_feature (18)..(25): n stands for any nucleotide and can be optionally absent
cugugagaagaagacagcaccagagaaacacacguugugguacauuaccuggua

SEQ ID NO: 5576 - RNA, 54 nt, Artificial Sequence
  Description of Artificial Sequence:  Enzymatic Nucleic Acid
  misc_feature (18)..(25): n stands for any nucleotide and can be optionally absent
cauuuaugagaagcuuccaccagagaaacacacguugugguacauuaccuggua

SEQ ID NO: 5577 - RNA, 54 nt, Artificial Sequence
  Description of Artificial Sequence:  Enzymatic Nucleic Acid
  misc_feature (18)..(25): n stands for any nucleotide and can be optionally absent
cuuccacaagaagauuuaaccagagaaacacacguugugguacauuaccuggua

SEQ ID NO: 5578 - RNA, 54 nt, Artificial Sequence
  Description of Artificial Sequence:  Enzymatic Nucleic Acid
  misc_feature (18)..(25): n stands for any nucleotide and can be optionally absent
uuugcuugagaaguguucaccagagaaacacacguugugguacauuaccuggua

SEQ ID NO: 5579 - RNA, 54 nt, Artificial Sequence
  Description of Artificial Sequence:  Enzymatic Nucleic Acid
  misc_feature (18)..(25): n stands for any nucleotide and can be optionally absent
auauuugcagaaguagaaaccagagaaacacacguugugguacauuaccuggua

SEQ ID NO: 5580 - RNA, 54 nt, Artificial Sequence
  Description of Artificial Sequence:  Enzymatic Nucleic Acid
  misc_feature (18)..(25): n stands for any nucleotide and can be optionally absent
cguaacccagaagggaauaccagagaaacacacguugugguacauuaccuggua

SEQ ID NO: 5581 - RNA, 54 nt, Artificial Sequence
  Description of Artificial Sequence:  Enzymatic Nucleic Acid
  misc_feature (18)..(25): n stands for any nucleotide and can be optionally absent
cguuuuccagaagggaucaccagagaaacacacguugugguacauuaccuggua

SEQ ID NO: 5582 - RNA, 54 nt, Artificial Sequence
  Description of Artificial Sequence:  Enzymatic Nucleic Acid
  misc_feature (18)..(25): n stands for any nucleotide and can be optionally absent
cuucacagagaagaagccaccagagaaacacacguugugguacauuaccuggua

SEQ ID NO: 5583 - RNA, 54 nt, Artificial Sequence
  Description of Artificial Sequence:  Enzymatic Nucleic Acid
  misc_feature (18)..(25): n stands for any nucleotide and can be optionally absent
uuuuuuucagaaggguaaaccagagaaacacacguugugguacauuaccuggua

SEQ ID NO: 5584 - RNA, 54 nt, Artificial Sequence
  Description of Artificial Sequence:  Enzymatic Nucleic Acid
  misc_feature (18)..(25): n stands for any nucleotide and can be optionally absent
gccgguaaagaagcuugcaccagagaaacacacguugugguacauuaccuggua

SEQ ID NO: 5585 - RNA, 54 nt, Artificial Sequence
  Description of Artificial Sequence:  Enzymatic Nucleic Acid
  misc_feature (18)..(25): n stands for any nucleotide and can be optionally absent
ucauagagagaagguaagaccagagaaacacacguugugguacauuaccuggua

SEQ ID NO: 5586 - RNA, 54 nt, Artificial Sequence
  Description of Artificial Sequence:  Enzymatic Nucleic Acid
  misc_feature (18)..(25): n stands for any nucleotide and can be optionally absent
aaauagcgagaagauuucaccagagaaacacacguugugguacauuaccuggua

SEQ ID NO: 5587 - RNA, 54 nt, Artificial Sequence
  Description of Artificial Sequence:  Enzymatic Nucleic Acid
  misc_feature (18)..(25): n stands for any nucleotide and can be optionally absent
uuucguaaagaagggguuaccagagaaacacacguugugguacauuaccuggua

SEQ ID NO: 5588 - RNA, 54 nt, Artificial Sequence
  Description of Artificial Sequence:  Enzymatic Nucleic Acid
  misc_feature (18)..(25): n stands for any nucleotide and can be optionally absent
agagccggagaaggaaacaccagagaaacacacguugugguacauuaccuggua

SEQ ID NO: 5589 - RNA, 54 nt, Artificial Sequence
  Description of Artificial Sequence:  Enzymatic Nucleic Acid
  misc_feature (18)..(25): n stands for any nucleotide and can be optionally absent
ggguagagagaagggucuaccagagaaacacacguugugguacauuaccuggua

SEQ ID NO: 5590 - RNA, 54 nt, Artificial Sequence
  Description of Artificial Sequence:  Enzymatic Nucleic Acid
  misc_feature (18)..(25): n stands for any nucleotide and can be optionally absent
cgguacaaagaaggauuuaccagagaaacacacguugugguacauuaccuggua

SEQ ID NO: 5591 - RNA, 54 nt, Artificial Sequence
  Description of Artificial Sequence:  Enzymatic Nucleic Acid
  misc_feature (18)..(25): n stands for any nucleotide and can be optionally absent
auucuagaagaagccacaaccagagaaacacacguugugguacauuaccuggua

SEQ ID NO: 5592 - RNA, 54 nt, Artificial Sequence
  Description of Artificial Sequence:  Enzymatic Nucleic Acid
  misc_feature (18)..(25): n stands for any nucleotide and can be optionally absent
uuuggcacagaagugauaaccagagaaacacacguugugguacauuaccuggua

SEQ ID NO: 5593 - RNA, 54 nt, Artificial Sequence
  Description of Artificial Sequence:  Enzymatic Nucleic Acid
  misc_feature (18)..(25): n stands for any nucleotide and can be optionally absent
cuccuuccagaagcauuuaccagagaaacacacguugugguacauuaccuggua

SEQ ID NO: 5594 - RNA, 54 nt, Artificial Sequence
  Description of Artificial Sequence:  Enzymatic Nucleic Acid
  misc_feature (18)..(25): n stands for any nucleotide and can be optionally absent
cugugcaaagaaguuucaaccagagaaacacacguugugguacauuaccuggua

SEQ ID NO: 5595 - RNA, 54 nt, Artificial Sequence
  Description of Artificial Sequence:  Enzymatic Nucleic Acid
  misc_feature (18)..(25): n stands for any nucleotide and can be optionally absent
agugguggagaagcugauaccagagaaacacacguugugguacauuaccuggua

SEQ ID NO: 5596 - RNA, 54 nt, Artificial Sequence
  Description of Artificial Sequence:  Enzymatic Nucleic Acid
  misc_feature (18)..(25): n stands for any nucleotide and can be optionally absent
accaagugagaagaggcuaccagagaaacacacguugugguacauuaccuggua

SEQ ID NO: 5597 - RNA, 54 nt, Artificial Sequence
  Description of Artificial Sequence:  Enzymatic Nucleic Acid
  misc_feature (18)..(25): n stands for any nucleotide and can be optionally absent
uuucaauaagaagcgugcaccagagaaacacacguugugguacauuaccuggua

SEQ ID NO: 5598 - RNA, 54 nt, Artificial Sequence
  Description of Artificial Sequence:  Enzymatic Nucleic Acid
  misc_feature (18)..(25): n stands for any nucleotide and can be optionally absent
guuccuugagaagugaggaccagagaaacacacguugugguacauuaccuggua

SEQ ID NO: 5599 - RNA, 54 nt, Artificial Sequence
  Description of Artificial Sequence:  Enzymatic Nucleic Acid
  misc_feature (18)..(25): n stands for any nucleotide and can be optionally absent
uuagagugagaagcuccaaccagagaaacacacguugugguacauuaccuggua

SEQ ID NO: 5600 - RNA, 54 nt, Artificial Sequence
  Description of Artificial Sequence:  Enzymatic Nucleic Acid
  misc_feature (18)..(25): n stands for any nucleotide and can be optionally absent
gauagguaagaagucuuuaccagagaaacacacguugugguacauuaccuggua

SEQ ID NO: 5601 - RNA, 54 nt, Artificial Sequence
  Description of Artificial Sequence:  Enzymatic Nucleic Acid
  misc_feature (18)..(25): n stands for any nucleotide and can be optionally absent
ggaacuucagaaggguccaccagagaaacacacguugugguacauuaccuggua

SEQ ID NO: 5602 - RNA, 54 nt, Artificial Sequence
  Description of Artificial Sequence:  Enzymatic Nucleic Acid
  misc_feature (18)..(25): n stands for any nucleotide and can be optionally absent
cauaagggagaagcucacaccagagaaacacacguugugguacauuaccuggua

SEQ ID NO: 5603 - RNA, 54 nt, Artificial Sequence
  Description of Artificial Sequence:  Enzymatic Nucleic Acid
  misc_feature (18)..(25): n stands for any nucleotide and can be optionally absent
cagccacaagaaggcacgaccagagaaacacacguugugguacauuaccuggua

SEQ ID NO: 5604 - RNA, 54 nt, Artificial Sequence
  Description of Artificial Sequence:  Enzymatic Nucleic Acid
  misc_feature (18)..(25): n stands for any nucleotide and can be optionally absent
gcucagucagaagagcuuaccagagaaacacacguugugguacauuaccuggua

SEQ ID NO: 5605 - RNA, 54 nt, Artificial Sequence
  Description of Artificial Sequence:  Enzymatic Nucleic Acid
  misc_feature (18)..(25): n stands for any nucleotide and can be optionally absent
aggcucccagaagguuaaaccagagaaacacacguugugguacauuaccuggua

SEQ ID NO: 5606 - RNA, 54 nt, Artificial Sequence
  Description of Artificial Sequence:  Enzymatic Nucleic Acid
  misc_feature (18)..(25): n stands for any nucleotide and can be optionally absent
caaucaccagaagaggccaccagagaaacacacguugugguacauuaccuggua

SEQ ID NO: 5607 - RNA, 54 nt, Artificial Sequence
  Description of Artificial Sequence:  Enzymatic Nucleic Acid
  misc_feature (18)..(25): n stands for any nucleotide and can be optionally absent
uuccugaaagaaggagcuaccagagaaacacacguugugguacauuaccuggua

SEQ ID NO: 5608 - RNA, 54 nt, Artificial Sequence
  Description of Artificial Sequence:  Enzymatic Nucleic Acid
  misc_feature (18)..(25): n stands for any nucleotide and can be optionally absent
uagaaaccagaagaauccaccagagaaacacacguugugguacauuaccuggua

SEQ ID NO: 5609 - RNA, 54 nt, Artificial Sequence
  Description of Artificial Sequence:  Enzymatic Nucleic Acid
  misc_feature (18)..(25): n stands for any nucleotide and can be optionally absent
cuuguagaagaagucagaaccagagaaacacacguugugguacauuaccuggua

SEQ ID NO: 5610 - RNA, 54 nt, Artificial Sequence
  Description of Artificial Sequence:  Enzymatic Nucleic Acid
  misc_feature (18)..(25): n stands for any nucleotide and can be optionally absent
uguaagaaagaagaucuuaccagagaaacacacguugugguacauuaccuggua

SEQ ID NO: 5611 - RNA, 54 nt, Artificial Sequence
  Description of Artificial Sequence:  Enzymatic Nucleic Acid
  misc_feature (18)..(25): n stands for any nucleotide and can be optionally absent
cacuugaaagaaguaagaaccagagaaacacacguugugguacauuaccuggua

SEQ ID NO: 5612 - RNA, 54 nt, Artificial Sequence
  Description of Artificial Sequence:  Enzymatic Nucleic Acid
  misc_feature (18)..(25): n stands for any nucleotide and can be optionally absent
uucuggaaagaaggaacuaccagagaaacacacguugugguacauuaccuggua

SEQ ID NO: 5613 - RNA, 54 nt, Artificial Sequence
  Description of Artificial Sequence:  Enzymatic Nucleic Acid
  misc_feature (18)..(25): n stands for any nucleotide and can be optionally absent
cucacauaagaaggguucaccagagaaacacacguugugguacauuaccuggua

SEQ ID NO: 5614 - RNA, 54 nt, Artificial Sequence
  Description of Artificial Sequence:  Enzymatic Nucleic Acid
  misc_feature (18)..(25): n stands for any nucleotide and can be optionally absent
ccucaggcagaagcaaaaaccagagaaacacacguugugguacauuaccuggua

SEQ ID NO: 5615 - RNA, 54 nt, Artificial Sequence
  Description of Artificial Sequence:  Enzymatic Nucleic Acid
  misc_feature (18)..(25): n stands for any nucleotide and can be optionally absent
ccagcaugagaagauagaaccagagaaacacacguugugguacauuaccuggua

SEQ ID NO: 5616 - RNA, 54 nt, Artificial Sequence
  Description of Artificial Sequence:  Enzymatic Nucleic Acid
  misc_feature (18)..(25): n stands for any nucleotide and can be optionally absent
ucugugccagaaguccagaccagagaaacacacguugugguacauuaccuggua

SEQ ID NO: 5617 - RNA, 54 nt, Artificial Sequence
  Description of Artificial Sequence:  Enzymatic Nucleic Acid
  misc_feature (18)..(25): n stands for any nucleotide and can be optionally absent
ucagagaaagaaggaguuaccagagaaacacacguugugguacauuaccuggua

SEQ ID NO: 5618 - RNA, 54 nt, Artificial Sequence
  Description of Artificial Sequence:  Enzymatic Nucleic Acid
  misc_feature (18)..(25): n stands for any nucleotide and can be optionally absent
aacuucggagaagaaauaaccagagaaacacacguugugguacauuaccuggua

SEQ ID NO: 5619 - RNA, 54 nt, Artificial Sequence
  Description of Artificial Sequence:  Enzymatic Nucleic Acid
  misc_feature (18)..(25): n stands for any nucleotide and can be optionally absent
cugacaucagaagagcuuaccagagaaacacacguugugguacauuaccuggua

SEQ ID NO: 5620 - RNA, 54 nt, Artificial Sequence
  Description of Artificial Sequence:  Enzymatic Nucleic Acid
  misc_feature (18)..(25): n stands for any nucleotide and can be optionally absent
gagaggccagaagagugcaccagagaaacacacguugugguacauuaccuggua

SEQ ID NO: 5621 - RNA, 54 nt, Artificial Sequence
  Description of Artificial Sequence:  Enzymatic Nucleic Acid
  misc_feature (18)..(25): n stands for any nucleotide and can be optionally absent
ugacaucaagaagccccgaccagagaaacacacguugugguacauuaccuggua

SEQ ID NO: 5622 - RNA, 54 nt, Artificial Sequence
  Description of Artificial Sequence:  Enzymatic Nucleic Acid
  misc_feature (18)..(25): n stands for any nucleotide and can be optionally absent
cugcugacagaagacagcaccagagaaacacacguugugguacauuaccuggua

SEQ ID NO: 5623 - RNA, 54 nt, Artificial Sequence
  Description of Artificial Sequence:  Enzymatic Nucleic Acid
  misc_feature (18)..(25): n stands for any nucleotide and can be optionally absent
auggcagaagaagggccuaccagagaaacacacguugugguacauuaccuggua

SEQ ID NO: 5624 - RNA, 54 nt, Artificial Sequence
  Description of Artificial Sequence:  Enzymatic Nucleic Acid
  misc_feature (18)..(25): n stands for any nucleotide and can be optionally absent
gugcccacagaaggaaugaccagagaaacacacguugugguacauuaccuggua

SEQ ID NO: 5625 - RNA, 54 nt, Artificial Sequence
  Description of Artificial Sequence:  Enzymatic Nucleic Acid
  misc_feature (18)..(25): n stands for any nucleotide and can be optionally absent
gggcggggagaagcacgcaccagagaaacacacguugugguacauuaccuggua

SEQ ID NO: 5626 - RNA, 54 nt, Artificial Sequence
  Description of Artificial Sequence:  Enzymatic Nucleic Acid
  misc_feature (18)..(25): n stands for any nucleotide and can be optionally absent
agucugggagaagggagcaccagagaaacacacguugugguacauuaccuggua

SEQ ID NO: 5627 - RNA, 54 nt, Artificial Sequence
  Description of Artificial Sequence:  Enzymatic Nucleic Acid
  misc_feature (18)..(25): n stands for any nucleotide and can be optionally absent
gaguuguaagaagggggcaccagagaaacacacguugugguacauuaccuggua

SEQ ID NO: 5628 - RNA, 54 nt, Artificial Sequence
  Description of Artificial Sequence:  Enzymatic Nucleic Acid
  misc_feature (18)..(25): n stands for any nucleotide and can be optionally absent
caaaaagcagaaggcuccaccagagaaacacacguugugguacauuaccuggua

SEQ ID NO: 5629 - RNA, 54 nt, Artificial Sequence
  Description of Artificial Sequence:  Enzymatic Nucleic Acid
  misc_feature (18)..(25): n stands for any nucleotide and can be optionally absent
ucacaaaaagaagcuggcaccagagaaacacacguugugguacauuaccuggua

SEQ ID NO: 5630 - RNA, 54 nt, Artificial Sequence
  Description of Artificial Sequence:  Enzymatic Nucleic Acid
  misc_feature (18)..(25): n stands for any nucleotide and can be optionally absent
gggguuggagaagggaagaccagagaaacacacguugugguacauuaccuggua

SEQ ID NO: 5631 - RNA, 54 nt, Artificial Sequence
  Description of Artificial Sequence:  Enzymatic Nucleic Acid
  misc_feature (18)..(25): n stands for any nucleotide and can be optionally absent
cucaaucaagaagguccuaccagagaaacacacguugugguacauuaccuggua

SEQ ID NO: 5632 - RNA, 54 nt, Artificial Sequence
  Description of Artificial Sequence:  Enzymatic Nucleic Acid
  misc_feature (18)..(25): n stands for any nucleotide and can be optionally absent
auugggugagaagugcagaccagagaaacacacguugugguacauuaccuggua

SEQ ID NO: 5633 - RNA, 54 nt, Artificial Sequence
  Description of Artificial Sequence:  Enzymatic Nucleic Acid
  misc_feature (18)..(25): n stands for any nucleotide and can be optionally absent
ggcugcagagaaggcccaaccagagaaacacacguugugguacauuaccuggua

SEQ ID NO: 5634 - RNA, 54 nt, Artificial Sequence
  Description of Artificial Sequence:  Enzymatic Nucleic Acid
  misc_feature (18)..(25): n stands for any nucleotide and can be optionally absent
ggguuuugagaagcagggaccagagaaacacacguugugguacauuaccuggua

SEQ ID NO: 5635 - RNA, 54 nt, Artificial Sequence
  Description of Artificial Sequence:  Enzymatic Nucleic Acid
  misc_feature (18)..(25): n stands for any nucleotide and can be optionally absent
agggucagagaagggaagaccagagaaacacacguugugguacauuaccuggua

SEQ ID NO: 5636 - RNA, 54 nt, Artificial Sequence
  Description of Artificial Sequence:  Enzymatic Nucleic Acid
  misc_feature (18)..(25): n stands for any nucleotide and can be optionally absent
guagaaggagaagagcugaccagagaaacacacguugugguacauuaccuggua

SEQ ID NO: 5637 - RNA, 54 nt, Artificial Sequence
  Description of Artificial Sequence:  Enzymatic Nucleic Acid
  misc_feature (18)..(25): n stands for any nucleotide and can be optionally absent
cgcuguccagaagcuccuaccagagaaacacacguugugguacauuaccuggua

SEQ ID NO: 5638 - RNA, 54 nt, Artificial Sequence
  Description of Artificial Sequence:  Enzymatic Nucleic Acid
  misc_feature (18)..(25): n stands for any nucleotide and can be optionally absent
cugugcaaagaagaauaaaccagagaaacacacguugugguacauuaccuggua

SEQ ID NO: 5639 - RNA, 54 nt, Artificial Sequence
  Description of Artificial Sequence:  Enzymatic Nucleic Acid
  misc_feature (18)..(25): n stands for any nucleotide and can be optionally absent
cuccucagagaagcauuuaccagagaaacacacguugugguacauuaccuggua

SEQ ID NO: 5640 - RNA, 54 nt, Artificial Sequence
  Description of Artificial Sequence:  Enzymatic Nucleic Acid
  misc_feature (18)..(25): n stands for any nucleotide and can be optionally absent
uuuccuccagaagcccucaccagagaaacacacguugugguacauuaccuggua

SEQ ID NO: 5641 - RNA, 54 nt, Artificial Sequence
  Description of Artificial Sequence:  Enzymatic Nucleic Acid
  misc_feature (18)..(25): n stands for any nucleotide and can be optionally absent
gguauagaagaagggucuaccagagaaacacacguugugguacauuaccuggua

SEQ ID NO: 5642 - RNA, 54 nt, Artificial Sequence
  Description of Artificial Sequence:  Enzymatic Nucleic Acid
  misc_feature (18)..(25): n stands for any nucleotide and can be optionally absent
ugggucccagaaguguugaccagagaaacacacguugugguacauuaccuggua

SEQ ID NO: 5643 - RNA, 54 nt, Artificial Sequence
  Description of Artificial Sequence:  Enzymatic Nucleic Acid
  misc_feature (18)..(25): n stands for any nucleotide and can be optionally absent
ugagucccagaaggagaaaccagagaaacacacguugugguacauuaccuggua

SEQ ID NO: 5644 - RNA, 54 nt, Artificial Sequence
  Description of Artificial Sequence:  Enzymatic Nucleic Acid
  misc_feature (18)..(25): n stands for any nucleotide and can be optionally absent
aguuucaaagaaguugaaaccagagaaacacacguugugguacauuaccuggua

SEQ ID NO: 5645 - RNA, 54 nt, Artificial Sequence
  Description of Artificial Sequence:  Enzymatic Nucleic Acid
  misc_feature (18)..(25): n stands for any nucleotide and can be optionally absent
uagcaucaagaagagccaaccagagaaacacacguugugguacauuaccuggua

SEQ ID NO: 5646 - RNA, 54 nt, Artificial Sequence
  Description of Artificial Sequence:  Enzymatic Nucleic Acid
  misc_feature (18)..(25): n stands for any nucleotide and can be optionally absent
ccccaagaagaagcaaucaccagagaaacacacguugugguacauuaccuggua

SEQ ID NO: 5647 - RNA, 54 nt, Artificial Sequence
  Description of Artificial Sequence:  Enzymatic Nucleic Acid
  misc_feature (18)..(25): n stands for any nucleotide and can be optionally absent
cacauaagagaagaggcaaccagagaaacacacguugugguacauuaccuggua

SEQ ID NO: 5648 - RNA, 54 nt, Artificial Sequence
  Description of Artificial Sequence:  Enzymatic Nucleic Acid
  misc_feature (18)..(25): n stands for any nucleotide and can be optionally absent
uccacaaaagaagcugccaccagagaaacacacguugugguacauuaccuggua

SEQ ID NO: 5649 - RNA, 54 nt, Artificial Sequence
  Description of Artificial Sequence:  Enzymatic Nucleic Acid
  misc_feature (18)..(25): n stands for any nucleotide and can be optionally absent
guggagagagaagucccaaccagagaaacacacguugugguacauuaccuggua

SEQ ID NO: 5650 - RNA, 54 nt, Artificial Sequence
  Description of Artificial Sequence:  Enzymatic Nucleic Acid
  misc_feature (18)..(25): n stands for any nucleotide and can be optionally absent
aaauugccagaagucacaaccagagaaacacacguugugguacauuaccuggua

SEQ ID NO: 5651 - RNA, 54 nt, Artificial Sequence
  Description of Artificial Sequence:  Enzymatic Nucleic Acid
  misc_feature (18)..(25): n stands for any nucleotide and can be optionally absent
aagacaugagaagcuaagaccagagaaacacacguugugguacauuaccuggua

SEQ ID NO: 5652 - RNA, 54 nt, Artificial Sequence
  Description of Artificial Sequence:  Enzymatic Nucleic Acid
  misc_feature (18)..(25): n stands for any nucleotide and can be optionally absent
uuugaaggagaagaguaaaccagagaaacacacguugugguacauuaccuggua

SEQ ID NO: 5653 - RNA, 54 nt, Artificial Sequence
  Description of Artificial Sequence:  Enzymatic Nucleic Acid
  misc_feature (18)..(25): n stands for any nucleotide and can be optionally absent
uccacccaagaaguuccaaccagagaaacacacguugugguacauuaccuggua

SEQ ID NO: 5654 - RNA, 54 nt, Artificial Sequence
  Description of Artificial Sequence:  Enzymatic Nucleic Acid
  misc_feature (18)..(25): n stands for any nucleotide and can be optionally absent
acuucuugagaagacaagaccagagaaacacacguugugguacauuaccuggua

SEQ ID NO: 5655 - RNA, 54 nt, Artificial Sequence
  Description of Artificial Sequence:  Enzymatic Nucleic Acid
  misc_feature (18)..(25): n stands for any nucleotide and can be optionally absent
aacauaaaagaaguugccaccagagaaacacacguugugguacauuaccuggua

SEQ ID NO: 5656 - RNA, 54 nt, Artificial Sequence
  Description of Artificial Sequence:  Enzymatic Nucleic Acid
  misc_feature (18)..(25): n stands for any nucleotide and can be optionally absent
uggaaggaagaagaacauaccagagaaacacacguugugguacauuaccuggua

SEQ ID NO: 5657 - RNA, 54 nt, Artificial Sequence
  Description of Artificial Sequence:  Enzymatic Nucleic Acid
  misc_feature (18)..(25): n stands for any nucleotide and can be optionally absent
cccauacaagaagcuaaaaccagagaaacacacguugugguacauuaccuggua

SEQ ID NO: 5658 - RNA, 54 nt, Artificial Sequence
  Description of Artificial Sequence:  Enzymatic Nucleic Acid
  misc_feature (18)..(25): n stands for any nucleotide and can be optionally absent
uuuucaugagaaggaauuaccagagaaacacacguugugguacauuaccuggua

SEQ ID NO: 5659 - RNA, 54 nt, Artificial Sequence
  Description of Artificial Sequence:  Enzymatic Nucleic Acid
  misc_feature (18)..(25): n stands for any nucleotide and can be optionally absent
gacauucaagaagaaaugaccagagaaacacacguugugguacauuaccuggua

SEQ ID NO: 5660 - RNA, 54 nt, Artificial Sequence
  Description of Artificial Sequence:  Enzymatic Nucleic Acid
  misc_feature (18)..(25): n stands for any nucleotide and can be optionally absent
aauauauaagaagacauuaccagagaaacacacguugugguacauuaccuggua

SEQ ID NO: 5661 - RNA, 54 nt, Artificial Sequence
  Description of Artificial Sequence:  Enzymatic Nucleic Acid
  misc_feature (18)..(25): n stands for any nucleotide and can be optionally absent
auacaaagagaagagaauaccagagaaacacacguugugguacauuaccuggua

SEQ ID NO: 5662 - RNA, 38 nt, Artificial Sequence
  Description of Artificial Sequence:  Enzymatic Nucleic Acid
  misc_feature (18)..(25): n stands for any nucleotide and can be optionally absent
cacagggccugaugaggnnnnnnnnccgaaacggccag

SEQ ID NO: 5663 - RNA, 38 nt, Artificial Sequence
  Description of Artificial Sequence:  Enzymatic Nucleic Acid
  misc_feature (18)..(25): n stands for any nucleotide and can be optionally absent
uccacgcacugaugaggnnnnnnnnccgaaagccacag

SEQ ID NO: 5664 - RNA, 38 nt, Artificial Sequence
  Description of Artificial Sequence:  Enzymatic Nucleic Acid
  misc_feature (18)..(25): n stands for any nucleotide and can be optionally absent
aacccacacugaugaggnnnnnnnnccgaaaggcggcc

SEQ ID NO: 5665 - RNA, 38 nt, Artificial Sequence
  Description of Artificial Sequence:  Enzymatic Nucleic Acid
  misc_feature (18)..(25): n stands for any nucleotide and can be optionally absent
acuaggcacugaugaggnnnnnnnnccgaaacccacag

SEQ ID NO: 5666 - RNA, 38 nt, Artificial Sequence
  Description of Artificial Sequence:  Enzymatic Nucleic Acid
  misc_feature (18)..(25): n stands for any nucleotide and can be optionally absent
cacuaggccugaugaggnnnnnnnnccgaaaacccaca

SEQ ID NO: 5667 - RNA, 38 nt, Artificial Sequence
  Description of Artificial Sequence:  Enzymatic Nucleic Acid
  misc_feature (18)..(25): n stands for any nucleotide and can be optionally absent
agaaacaccugaugaggnnnnnnnnccgaaaggcaaac

SEQ ID NO: 5668 - RNA, 38 nt, Artificial Sequence
  Description of Artificial Sequence:  Enzymatic Nucleic Acid
  misc_feature (18)..(25): n stands for any nucleotide and can be optionally absent
ucaagagacugaugaggnnnnnnnnccgaaacacuagg

SEQ ID NO: 5669 - RNA, 38 nt, Artificial Sequence
  Description of Artificial Sequence:  Enzymatic Nucleic Acid
  misc_feature (18)..(25): n stands for any nucleotide and can be optionally absent
aucaagagcugaugaggnnnnnnnnccgaaaacacuag

SEQ ID NO: 5670 - RNA, 38 nt, Artificial Sequence
  Description of Artificial Sequence:  Enzymatic Nucleic Acid
  misc_feature (18)..(25): n stands for any nucleotide and can be optionally absent
gaucaagacugaugaggnnnnnnnnccgaaaaacacua

SEQ ID NO: 5671 - RNA, 38 nt, Artificial Sequence
  Description of Artificial Sequence:  Enzymatic Nucleic Acid
  misc_feature (18)..(25): n stands for any nucleotide and can be optionally absent
cagaucaacugaugaggnnnnnnnnccgaaagaaacac

SEQ ID NO: 5672 - RNA, 38 nt, Artificial Sequence
  Description of Artificial Sequence:  Enzymatic Nucleic Acid
  misc_feature (18)..(25): n stands for any nucleotide and can be optionally absent
ggcagauccugaugaggnnnnnnnnccgaaagagaaac

SEQ ID NO: 5673 - RNA, 38 nt, Artificial Sequence
  Description of Artificial Sequence:  Enzymatic Nucleic Acid
  misc_feature (18)..(25): n stands for any nucleotide and can be optionally absent
ccugggcacugaugaggnnnnnnnnccgaaaucaagag

SEQ ID NO: 5674 - RNA, 38 nt, Artificial Sequence
  Description of Artificial Sequence:  Enzymatic Nucleic Acid
  misc_feature (18)..(25): n stands for any nucleotide and can be optionally absent
uguaugcucugaugaggnnnnnnnnccgaaagccuggg

SEQ ID NO: 5675 - RNA, 38 nt, Artificial Sequence
  Description of Artificial Sequence:  Enzymatic Nucleic Acid
  misc_feature (18)..(25): n stands for any nucleotide and can be optionally absent
ucuuuuugcugaugaggnnnnnnnnccgaaaugcugag

SEQ ID NO: 5676 - RNA, 38 nt, Artificial Sequence
  Description of Artificial Sequence:  Enzymatic Nucleic Acid
  misc_feature (18)..(25): n stands for any nucleotide and can be optionally absent
auuguaagcugaugaggnnnnnnnnccgaaaugucuuu

SEQ ID NO: 5677 - RNA, 38 nt, Artificial Sequence
  Description of Artificial Sequence:  Enzymatic Nucleic Acid
  misc_feature (18)..(25): n stands for any nucleotide and can be optionally absent
uuaauugucugaugaggnnnnnnnnccgaaaguauguc

SEQ ID NO: 5678 - RNA, 38 nt, Artificial Sequence
  Description of Artificial Sequence:  Enzymatic Nucleic Acid
  misc_feature (18)..(25): n stands for any nucleotide and can be optionally absent
cuuaauugcugaugaggnnnnnnnnccgaaaaguaugu

SEQ ID NO: 5679 - RNA, 38 nt, Artificial Sequence
  Description of Artificial Sequence:  Enzymatic Nucleic Acid
  misc_feature (18)..(25): n stands for any nucleotide and can be optionally absent
uuagccuucugaugaggnnnnnnnnccgaaauuguaag

SEQ ID NO: 5680 - RNA, 38 nt, Artificial Sequence
  Description of Artificial Sequence:  Enzymatic Nucleic Acid
  misc_feature (18)..(25): n stands for any nucleotide and can be optionally absent
auuagccucugaugaggnnnnnnnnccgaaaauuguaa

SEQ ID NO: 5681 - RNA, 38 nt, Artificial Sequence
  Description of Artificial Sequence:  Enzymatic Nucleic Acid
  misc_feature (18)..(25): n stands for any nucleotide and can be optionally absent
aguuguaucugaugaggnnnnnnnnccgaaagccuuaa

SEQ ID NO: 5682 - RNA, 38 nt, Artificial Sequence
  Description of Artificial Sequence:  Enzymatic Nucleic Acid
  misc_feature (18)..(25): n stands for any nucleotide and can be optionally absent
aagaguugcugaugaggnnnnnnnnccgaaauuagccu

SEQ ID NO: 5683 - RNA, 38 nt, Artificial Sequence
  Description of Artificial Sequence:  Enzymatic Nucleic Acid
  misc_feature (18)..(25): n stands for any nucleotide and can be optionally absent
aauuugaacugaugaggnnnnnnnnccgaaaguuguau

SEQ ID NO: 5684 - RNA, 38 nt, Artificial Sequence
  Description of Artificial Sequence:  Enzymatic Nucleic Acid
  misc_feature (18)..(25): n stands for any nucleotide and can be optionally absent
guaauuugcugaugaggnnnnnnnnccgaaagaguugu

SEQ ID NO: 5685 - RNA, 38 nt, Artificial Sequence
  Description of Artificial Sequence:  Enzymatic Nucleic Acid
  misc_feature (18)..(25): n stands for any nucleotide and can be optionally absent
aguaauuucugaugaggnnnnnnnnccgaaaagaguug

SEQ ID NO: 5686 - RNA, 38 nt, Artificial Sequence
  Description of Artificial Sequence:  Enzymatic Nucleic Acid
  misc_feature (18)..(25): n stands for any nucleotide and can be optionally absent
cugcaagucugaugaggnnnnnnnnccgaaauuugaag

SEQ ID NO: 5687 - RNA, 38 nt, Artificial Sequence
  Description of Artificial Sequence:  Enzymatic Nucleic Acid
  misc_feature (18)..(25): n stands for any nucleotide and can be optionally absent
ccugcaagcugaugaggnnnnnnnnccgaaaauuugaa

SEQ ID NO: 5688 - RNA, 38 nt, Artificial Sequence
  Description of Artificial Sequence:  Enzymatic Nucleic Acid
  misc_feature (18)..(25): n stands for any nucleotide and can be optionally absent
uccccugccugaugaggnnnnnnnnccgaaaguaauuu

SEQ ID NO: 5689 - RNA, 38 nt, Artificial Sequence
  Description of Artificial Sequence:  Enzymatic Nucleic Acid
  misc_feature (18)..(25): n stands for any nucleotide and can be optionally absent
gccagucccugaugaggnnnnnnnnccgaaagucccuc

SEQ ID NO: 5690 - RNA, 38 nt, Artificial Sequence
  Description of Artificial Sequence:  Enzymatic Nucleic Acid
  misc_feature (18)..(25): n stands for any nucleotide and can be optionally absent
uugggccacugaugaggnnnnnnnnccgaaagccaguc

SEQ ID NO: 5691 - RNA, 38 nt, Artificial Sequence
  Description of Artificial Sequence:  Enzymatic Nucleic Acid
  misc_feature (18)..(25): n stands for any nucleotide and can be optionally absent
auugggcccugaugaggnnnnnnnnccgaaaagccagu

SEQ ID NO: 5692 - RNA, 38 nt, Artificial Sequence
  Description of Artificial Sequence:  Enzymatic Nucleic Acid
  misc_feature (18)..(25): n stands for any nucleotide and can be optionally absent
acucugaucugaugaggnnnnnnnnccgaaauugggcc

SEQ ID NO: 5693 - RNA, 38 nt, Artificial Sequence
  Description of Artificial Sequence:  Enzymatic Nucleic Acid
  misc_feature (18)..(25): n stands for any nucleotide and can be optionally absent
gccacucucugaugaggnnnnnnnnccgaaauuauugg

SEQ ID NO: 5694 - RNA, 38 nt, Artificial Sequence
  Description of Artificial Sequence:  Enzymatic Nucleic Acid
  misc_feature (18)..(25): n stands for any nucleotide and can be optionally absent
uuacagaacugaugaggnnnnnnnnccgaaaggccauc

SEQ ID NO: 5695 - RNA, 38 nt, Artificial Sequence
  Description of Artificial Sequence:  Enzymatic Nucleic Acid
  misc_feature (18)..(25): n stands for any nucleotide and can be optionally absent
ucuuacagcugaugaggnnnnnnnnccgaaagaggcca

SEQ ID NO: 5696 - RNA, 38 nt, Artificial Sequence
  Description of Artificial Sequence:  Enzymatic Nucleic Acid
  misc_feature (18)..(25): n stands for any nucleotide and can be optionally absent
gucuuacacugaugaggnnnnnnnnccgaaaagaggcc

SEQ ID NO: 5697 - RNA, 38 nt, Artificial Sequence
  Description of Artificial Sequence:  Enzymatic Nucleic Acid
  misc_feature (18)..(25): n stands for any nucleotide and can be optionally absent
gagugucucugaugaggnnnnnnnnccgaaacagaaga

SEQ ID NO: 5698 - RNA, 38 nt, Artificial Sequence
  Description of Artificial Sequence:  Enzymatic Nucleic Acid
  misc_feature (18)..(25): n stands for any nucleotide and can be optionally absent
ggaauugucugaugaggnnnnnnnnccgaaagugucuu

SEQ ID NO: 5699 - RNA, 38 nt, Artificial Sequence
  Description of Artificial Sequence:  Enzymatic Nucleic Acid
  misc_feature (18)..(25): n stands for any nucleotide and can be optionally absent
acuuuuggcugaugaggnnnnnnnnccgaaauugugag

SEQ ID NO: 5700 - RNA, 38 nt, Artificial Sequence
  Description of Artificial Sequence:  Enzymatic Nucleic Acid
  misc_feature (18)..(25): n stands for any nucleotide and can be optionally absent
cacuuuugcugaugaggnnnnnnnnccgaaaauuguga

SEQ ID NO: 5701 - RNA, 38 nt, Artificial Sequence
  Description of Artificial Sequence:  Enzymatic Nucleic Acid
  misc_feature (18)..(25): n stands for any nucleotide and can be optionally absent
ucauuucccugaugaggnnnnnnnnccgaaaucacuuu

SEQ ID NO: 5702 - RNA, 38 nt, Artificial Sequence
  Description of Artificial Sequence:  Enzymatic Nucleic Acid
  misc_feature (18)..(25): n stands for any nucleotide and can be optionally absent
agcacuugcugaugaggnnnnnnnnccgaaaggcucca

SEQ ID NO: 5703 - RNA, 38 nt, Artificial Sequence
  Description of Artificial Sequence:  Enzymatic Nucleic Acid
  misc_feature (18)..(25): n stands for any nucleotide and can be optionally absent
cccgguagcugaugaggnnnnnnnnccgaaagcacuug

SEQ ID NO: 5704 - RNA, 38 nt, Artificial Sequence
  Description of Artificial Sequence:  Enzymatic Nucleic Acid
  misc_feature (18)..(25): n stands for any nucleotide and can be optionally absent
ucccgguacugaugaggnnnnnnnnccgaaaagcacuu

SEQ ID NO: 5705 - RNA, 38 nt, Artificial Sequence
  Description of Artificial Sequence:  Enzymatic Nucleic Acid
  misc_feature (18)..(25): n stands for any nucleotide and can be optionally absent
uuucccggcugaugaggnnnnnnnnccgaaagaagcac

SEQ ID NO: 5706 - RNA, 38 nt, Artificial Sequence
  Description of Artificial Sequence:  Enzymatic Nucleic Acid
  misc_feature (18)..(25): n stands for any nucleotide and can be optionally absent
ccgaggcccugaugaggnnnnnnnnccgaaagucaguu

SEQ ID NO: 5707 - RNA, 38 nt, Artificial Sequence
  Description of Artificial Sequence:  Enzymatic Nucleic Acid
  misc_feature (18)..(25): n stands for any nucleotide and can be optionally absent
aaaugacccugaugaggnnnnnnnnccgaaaggccaag

SEQ ID NO: 5708 - RNA, 38 nt, Artificial Sequence
  Description of Artificial Sequence:  Enzymatic Nucleic Acid
  misc_feature (18)..(25): n stands for any nucleotide and can be optionally absent
acauaaaucugaugaggnnnnnnnnccgaaaccgaggc

SEQ ID NO: 5709 - RNA, 38 nt, Artificial Sequence
  Description of Artificial Sequence:  Enzymatic Nucleic Acid
  misc_feature (18)..(25): n stands for any nucleotide and can be optionally absent
uagacauacugaugaggnnnnnnnnccgaaaugaccga

SEQ ID NO: 5710 - RNA, 38 nt, Artificial Sequence
  Description of Artificial Sequence:  Enzymatic Nucleic Acid
  misc_feature (18)..(25): n stands for any nucleotide and can be optionally absent
auagacaucugaugaggnnnnnnnnccgaaaaugaccg

SEQ ID NO: 5711 - RNA, 38 nt, Artificial Sequence
  Description of Artificial Sequence:  Enzymatic Nucleic Acid
  misc_feature (18)..(25): n stands for any nucleotide and can be optionally absent
cauagacacugaugaggnnnnnnnnccgaaaaaugacc

SEQ ID NO: 5712 - RNA, 38 nt, Artificial Sequence
  Description of Artificial Sequence:  Enzymatic Nucleic Acid
  misc_feature (18)..(25): n stands for any nucleotide and can be optionally absent
ugaacauacugaugaggnnnnnnnnccgaaacauaaau

SEQ ID NO: 5713 - RNA, 38 nt, Artificial Sequence
  Description of Artificial Sequence:  Enzymatic Nucleic Acid
  misc_feature (18)..(25): n stands for any nucleotide and can be optionally absent
cuugaacacugaugaggnnnnnnnnccgaaagacauaa

SEQ ID NO: 5714 - RNA, 38 nt, Artificial Sequence
  Description of Artificial Sequence:  Enzymatic Nucleic Acid
  misc_feature (18)..(25): n stands for any nucleotide and can be optionally absent
uaaucuugcugaugaggnnnnnnnnccgaaacauagac

SEQ ID NO: 5715 - RNA, 38 nt, Artificial Sequence
  Description of Artificial Sequence:  Enzymatic Nucleic Acid
  misc_feature (18)..(25): n stands for any nucleotide and can be optionally absent
guaaucuucugaugaggnnnnnnnnccgaaaacauaga

SEQ ID NO: 5716 - RNA, 38 nt, Artificial Sequence
  Description of Artificial Sequence:  Enzymatic Nucleic Acid
  misc_feature (18)..(25): n stands for any nucleotide and can be optionally absent
agaucugucugaugaggnnnnnnnnccgaaaucuugaa

SEQ ID NO: 5717 - RNA, 38 nt, Artificial Sequence
  Description of Artificial Sequence:  Enzymatic Nucleic Acid
  misc_feature (18)..(25): n stands for any nucleotide and can be optionally absent
gagaucugcugaugaggnnnnnnnnccgaaaaucuuga

SEQ ID NO: 5718 - RNA, 38 nt, Artificial Sequence
  Description of Artificial Sequence:  Enzymatic Nucleic Acid
  misc_feature (18)..(25): n stands for any nucleotide and can be optionally absent
uaaauggacugaugaggnnnnnnnnccgaaaucuguaa

SEQ ID NO: 5719 - RNA, 38 nt, Artificial Sequence
  Description of Artificial Sequence:  Enzymatic Nucleic Acid
  misc_feature (18)..(25): n stands for any nucleotide and can be optionally absent
aauaaaugcugaugaggnnnnnnnnccgaaagaucugu

SEQ ID NO: 5720 - RNA, 38 nt, Artificial Sequence
  Description of Artificial Sequence:  Enzymatic Nucleic Acid
  misc_feature (18)..(25): n stands for any nucleotide and can be optionally absent
aagcaauacugaugaggnnnnnnnnccgaaauggagau

SEQ ID NO: 5721 - RNA, 38 nt, Artificial Sequence
  Description of Artificial Sequence:  Enzymatic Nucleic Acid
  misc_feature (18)..(25): n stands for any nucleotide and can be optionally absent
gaagcaaucugaugaggnnnnnnnnccgaaaauggaga

SEQ ID NO: 5722 - RNA, 38 nt, Artificial Sequence
  Description of Artificial Sequence:  Enzymatic Nucleic Acid
  misc_feature (18)..(25): n stands for any nucleotide and can be optionally absent
agaagcaacugaugaggnnnnnnnnccgaaaaauggag

SEQ ID NO: 5723 - RNA, 38 nt, Artificial Sequence
  Description of Artificial Sequence:  Enzymatic Nucleic Acid
  misc_feature (18)..(25): n stands for any nucleotide and can be optionally absent
acagaagccugaugaggnnnnnnnnccgaaauaaaugg

SEQ ID NO: 5724 - RNA, 38 nt, Artificial Sequence
  Description of Artificial Sequence:  Enzymatic Nucleic Acid
  misc_feature (18)..(25): n stands for any nucleotide and can be optionally absent
acuaacagcugaugaggnnnnnnnnccgaaagcaauaa

SEQ ID NO: 5725 - RNA, 38 nt, Artificial Sequence
  Description of Artificial Sequence:  Enzymatic Nucleic Acid
  misc_feature (18)..(25): n stands for any nucleotide and can be optionally absent
cacuaacacugaugaggnnnnnnnnccgaaaagcaaua

SEQ ID NO: 5726 - RNA, 38 nt, Artificial Sequence
  Description of Artificial Sequence:  Enzymatic Nucleic Acid
  misc_feature (18)..(25): n stands for any nucleotide and can be optionally absent
uggucacucugaugaggnnnnnnnnccgaaacagaagc

SEQ ID NO: 5727 - RNA, 38 nt, Artificial Sequence
  Description of Artificial Sequence:  Enzymatic Nucleic Acid
  misc_feature (18)..(25): n stands for any nucleotide and can be optionally absent
uuggucaccugaugaggnnnnnnnnccgaaaacagaag

SEQ ID NO: 5728 - RNA, 38 nt, Artificial Sequence
  Description of Artificial Sequence:  Enzymatic Nucleic Acid
  misc_feature (18)..(25): n stands for any nucleotide and can be optionally absent
auguacaccugaugaggnnnnnnnnccgaaacuccaug

SEQ ID NO: 5729 - RNA, 38 nt, Artificial Sequence
  Description of Artificial Sequence:  Enzymatic Nucleic Acid
  misc_feature (18)..(25): n stands for any nucleotide and can be optionally absent
caguaaugcugaugaggnnnnnnnnccgaaacacgacu

SEQ ID NO: 5730 - RNA, 38 nt, Artificial Sequence
  Description of Artificial Sequence:  Enzymatic Nucleic Acid
  misc_feature (18)..(25): n stands for any nucleotide and can be optionally absent
uucucagucugaugaggnnnnnnnnccgaaauguacac

SEQ ID NO: 5731 - RNA, 38 nt, Artificial Sequence
  Description of Artificial Sequence:  Enzymatic Nucleic Acid
  misc_feature (18)..(25): n stands for any nucleotide and can be optionally absent
guucucagcugaugaggnnnnnnnnccgaaaauguaca

SEQ ID NO: 5732 - RNA, 38 nt, Artificial Sequence
  Description of Artificial Sequence:  Enzymatic Nucleic Acid
  misc_feature (18)..(25): n stands for any nucleotide and can be optionally absent
agacauggcugaugaggnnnnnnnnccgaaaucaccac

SEQ ID NO: 5733 - RNA, 38 nt, Artificial Sequence
  Description of Artificial Sequence:  Enzymatic Nucleic Acid
  misc_feature (18)..(25): n stands for any nucleotide and can be optionally absent
gagacaugcugaugaggnnnnnnnnccgaaaaucacca

SEQ ID NO: 5734 - RNA, 38 nt, Artificial Sequence
  Description of Artificial Sequence:  Enzymatic Nucleic Acid
  misc_feature (18)..(25): n stands for any nucleotide and can be optionally absent
ggacccgacugaugaggnnnnnnnnccgaaacauggaa

SEQ ID NO: 5735 - RNA, 38 nt, Artificial Sequence
  Description of Artificial Sequence:  Enzymatic Nucleic Acid
  misc_feature (18)..(25): n stands for any nucleotide and can be optionally absent
auggaccccugaugaggnnnnnnnnccgaaagacaugg

SEQ ID NO: 5736 - RNA, 38 nt, Artificial Sequence
  Description of Artificial Sequence:  Enzymatic Nucleic Acid
  misc_feature (18)..(25): n stands for any nucleotide and can be optionally absent
uugaaaugcugaugaggnnnnnnnnccgaaacccgaga

SEQ ID NO: 5737 - RNA, 38 nt, Artificial Sequence
  Description of Artificial Sequence:  Enzymatic Nucleic Acid
  misc_feature (18)..(25): n stands for any nucleotide and can be optionally absent
agauuugacugaugaggnnnnnnnnccgaaauggaccc

SEQ ID NO: 5738 - RNA, 38 nt, Artificial Sequence
  Description of Artificial Sequence:  Enzymatic Nucleic Acid
  misc_feature (18)..(25): n stands for any nucleotide and can be optionally absent
gagauuugcugaugaggnnnnnnnnccgaaaauggacc

SEQ ID NO: 5739 - RNA, 38 nt, Artificial Sequence
  Description of Artificial Sequence:  Enzymatic Nucleic Acid
  misc_feature (18)..(25): n stands for any nucleotide and can be optionally absent
ugagauuucugaugaggnnnnnnnnccgaaaaauggac

SEQ ID NO: 5740 - RNA, 38 nt, Artificial Sequence
  Description of Artificial Sequence:  Enzymatic Nucleic Acid
  misc_feature (18)..(25): n stands for any nucleotide and can be optionally absent
cacguugacugaugaggnnnnnnnnccgaaauuugaaa

SEQ ID NO: 5741 - RNA, 38 nt, Artificial Sequence
  Description of Artificial Sequence:  Enzymatic Nucleic Acid
  misc_feature (18)..(25): n stands for any nucleotide and can be optionally absent
gacacguucugaugaggnnnnnnnnccgaaagauuuga

SEQ ID NO: 5742 - RNA, 38 nt, Artificial Sequence
  Description of Artificial Sequence:  Enzymatic Nucleic Acid
  misc_feature (18)..(25): n stands for any nucleotide and can be optionally absent
cacaaagucugaugaggnnnnnnnnccgaaacacguug

SEQ ID NO: 5743 - RNA, 38 nt, Artificial Sequence
  Description of Artificial Sequence:  Enzymatic Nucleic Acid
  misc_feature (18)..(25): n stands for any nucleotide and can be optionally absent
cuugcacacugaugaggnnnnnnnnccgaaagugacac

SEQ ID NO: 5744 - RNA, 38 nt, Artificial Sequence
  Description of Artificial Sequence:  Enzymatic Nucleic Acid
  misc_feature (18)..(25): n stands for any nucleotide and can be optionally absent
ucuugcaccugaugaggnnnnnnnnccgaaaagugaca

SEQ ID NO: 5745 - RNA, 38 nt, Artificial Sequence
  Description of Artificial Sequence:  Enzymatic Nucleic Acid
  misc_feature (18)..(25): n stands for any nucleotide and can be optionally absent
uuucugggcugaugaggnnnnnnnnccgaaaucuugca

SEQ ID NO: 5746 - RNA, 38 nt, Artificial Sequence
  Description of Artificial Sequence:  Enzymatic Nucleic Acid
  misc_feature (18)..(25): n stands for any nucleotide and can be optionally absent
caggaacacugaugaggnnnnnnnnccgaaaucucuuu

SEQ ID NO: 5747 - RNA, 38 nt, Artificial Sequence
  Description of Artificial Sequence:  Enzymatic Nucleic Acid
  misc_feature (18)..(25): n stands for any nucleotide and can be optionally absent
ucaggaaccugaugaggnnnnnnnnccgaaaaucucuu

SEQ ID NO: 5748 - RNA, 38 nt, Artificial Sequence
  Description of Artificial Sequence:  Enzymatic Nucleic Acid
  misc_feature (18)..(25): n stands for any nucleotide and can be optionally absent
ccaucaggcugaugaggnnnnnnnnccgaaacaaaucu

SEQ ID NO: 5749 - RNA, 38 nt, Artificial Sequence
  Description of Artificial Sequence:  Enzymatic Nucleic Acid
  misc_feature (18)..(25): n stands for any nucleotide and can be optionally absent
accaucagcugaugaggnnnnnnnnccgaaaacaaauc

SEQ ID NO: 5750 - RNA, 38 nt, Artificial Sequence
  Description of Artificial Sequence:  Enzymatic Nucleic Acid
  misc_feature (18)..(25): n stands for any nucleotide and can be optionally absent
aauucugucugaugaggnnnnnnnnccgaaaccaucag

SEQ ID NO: 5751 - RNA, 38 nt, Artificial Sequence
  Description of Artificial Sequence:  Enzymatic Nucleic Acid
  misc_feature (18)..(25): n stands for any nucleotide and can be optionally absent
ucccaggacugaugaggnnnnnnnnccgaaauucuguu

SEQ ID NO: 5752 - RNA, 38 nt, Artificial Sequence
  Description of Artificial Sequence:  Enzymatic Nucleic Acid
  misc_feature (18)..(25): n stands for any nucleotide and can be optionally absent
gucccaggcugaugaggnnnnnnnnccgaaaauucugu

SEQ ID NO: 5753 - RNA, 38 nt, Artificial Sequence
  Description of Artificial Sequence:  Enzymatic Nucleic Acid
  misc_feature (18)..(25): n stands for any nucleotide and can be optionally absent
ugucccagcugaugaggnnnnnnnnccgaaaaauucug

SEQ ID NO: 5754 - RNA, 38 nt, Artificial Sequence
  Description of Artificial Sequence:  Enzymatic Nucleic Acid
  misc_feature (18)..(25): n stands for any nucleotide and can be optionally absent
gaauaguacugaugaggnnnnnnnnccgaaagcccuuc

SEQ ID NO: 5755 - RNA, 38 nt, Artificial Sequence
  Description of Artificial Sequence:  Enzymatic Nucleic Acid
  misc_feature (18)..(25): n stands for any nucleotide and can be optionally absent
ggaauagucugaugaggnnnnnnnnccgaaaagcccuu

SEQ ID NO: 5756 - RNA, 38 nt, Artificial Sequence
  Description of Artificial Sequence:  Enzymatic Nucleic Acid
  misc_feature (18)..(25): n stands for any nucleotide and can be optionally absent
gggaauagcugaugaggnnnnnnnnccgaaaaagcccu

SEQ ID NO: 5757 - RNA, 38 nt, Artificial Sequence
  Description of Artificial Sequence:  Enzymatic Nucleic Acid
  misc_feature (18)..(25): n stands for any nucleotide and can be optionally absent
gcugggaacugaugaggnnnnnnnnccgaaaguaaagc

SEQ ID NO: 5758 - RNA, 38 nt, Artificial Sequence
  Description of Artificial Sequence:  Enzymatic Nucleic Acid
  misc_feature (18)..(25): n stands for any nucleotide and can be optionally absent
uagcugggcugaugaggnnnnnnnnccgaaauaguaaa

SEQ ID NO: 5759 - RNA, 38 nt, Artificial Sequence
  Description of Artificial Sequence:  Enzymatic Nucleic Acid
  misc_feature (18)..(25): n stands for any nucleotide and can be optionally absent
guagcuggcugaugaggnnnnnnnnccgaaaauaguaa

SEQ ID NO: 5760 - RNA, 38 nt, Artificial Sequence
  Description of Artificial Sequence:  Enzymatic Nucleic Acid
  misc_feature (18)..(25): n stands for any nucleotide and can be optionally absent
ugaucaugcugaugaggnnnnnnnnccgaaagcuggga

SEQ ID NO: 5761 - RNA, 38 nt, Artificial Sequence
  Description of Artificial Sequence:  Enzymatic Nucleic Acid
  misc_feature (18)..(25): n stands for any nucleotide and can be optionally absent
gcauagcucugaugaggnnnnnnnnccgaaaucaugua

SEQ ID NO: 5762 - RNA, 38 nt, Artificial Sequence
  Description of Artificial Sequence:  Enzymatic Nucleic Acid
  misc_feature (18)..(25): n stands for any nucleotide and can be optionally absent
ugccagcacugaugaggnnnnnnnnccgaaagcugauc

SEQ ID NO: 5763 - RNA, 38 nt, Artificial Sequence
  Description of Artificial Sequence:  Enzymatic Nucleic Acid
  misc_feature (18)..(25): n stands for any nucleotide and can be optionally absent
ucacagaacugaugaggnnnnnnnnccgaaaccaugcc

SEQ ID NO: 5764 - RNA, 38 nt, Artificial Sequence
  Description of Artificial Sequence:  Enzymatic Nucleic Acid
  misc_feature (18)..(25): n stands for any nucleotide and can be optionally absent
cuucacagcugaugaggnnnnnnnnccgaaagaccaug

SEQ ID NO: 5765 - RNA, 38 nt, Artificial Sequence
  Description of Artificial Sequence:  Enzymatic Nucleic Acid
  misc_feature (18)..(25): n stands for any nucleotide and can be optionally absent
gcuucacacugaugaggnnnnnnnnccgaaaagaccau

SEQ ID NO: 5766 - RNA, 38 nt, Artificial Sequence
  Description of Artificial Sequence:  Enzymatic Nucleic Acid
  misc_feature (18)..(25): n stands for any nucleotide and can be optionally absent
ucaucauucugaugaggnnnnnnnnccgaaauuuuugc

SEQ ID NO: 5767 - RNA, 38 nt, Artificial Sequence
  Description of Artificial Sequence:  Enzymatic Nucleic Acid
  misc_feature (18)..(25): n stands for any nucleotide and can be optionally absent
uucaucaucugaugaggnnnnnnnnccgaaaauuuuug

SEQ ID NO: 5768 - RNA, 38 nt, Artificial Sequence
  Description of Artificial Sequence:  Enzymatic Nucleic Acid
  misc_feature (18)..(25): n stands for any nucleotide and can be optionally absent
agacuggucugaugaggnnnnnnnnccgaaacuuucau

SEQ ID NO: 5769 - RNA, 38 nt, Artificial Sequence
  Description of Artificial Sequence:  Enzymatic Nucleic Acid
  misc_feature (18)..(25): n stands for any nucleotide and can be optionally absent
uagacuggcugaugaggnnnnnnnnccgaaaacuuuca

SEQ ID NO: 5770 - RNA, 38 nt, Artificial Sequence
  Description of Artificial Sequence:  Enzymatic Nucleic Acid
  misc_feature (18)..(25): n stands for any nucleotide and can be optionally absent
acauaauacugaugaggnnnnnnnnccgaaacugguaa

SEQ ID NO: 5771 - RNA, 38 nt, Artificial Sequence
  Description of Artificial Sequence:  Enzymatic Nucleic Acid
  misc_feature (18)..(25): n stands for any nucleotide and can be optionally absent
guacauaacugaugaggnnnnnnnnccgaaagacuggu

SEQ ID NO: 5772 - RNA, 38 nt, Artificial Sequence
  Description of Artificial Sequence:  Enzymatic Nucleic Acid
  misc_feature (18)..(25): n stands for any nucleotide and can be optionally absent
auguacaucugaugaggnnnnnnnnccgaaauagacug

SEQ ID NO: 5773 - RNA, 38 nt, Artificial Sequence
  Description of Artificial Sequence:  Enzymatic Nucleic Acid
  misc_feature (18)..(25): n stands for any nucleotide and can be optionally absent
uauguacacugaugaggnnnnnnnnccgaaaauagacu

SEQ ID NO: 5774 - RNA, 38 nt, Artificial Sequence
  Description of Artificial Sequence:  Enzymatic Nucleic Acid
  misc_feature (18)..(25): n stands for any nucleotide and can be optionally absent
caacuaugcugaugaggnnnnnnnnccgaaacauaaua

SEQ ID NO: 5775 - RNA, 38 nt, Artificial Sequence
  Description of Artificial Sequence:  Enzymatic Nucleic Acid
  misc_feature (18)..(25): n stands for any nucleotide and can be optionally absent
acgacaaccugaugaggnnnnnnnnccgaaauguacau

SEQ ID NO: 5776 - RNA, 38 nt, Artificial Sequence
  Description of Artificial Sequence:  Enzymatic Nucleic Acid
  misc_feature (18)..(25): n stands for any nucleotide and can be optionally absent
acaacgaccugaugaggnnnnnnnnccgaaacuaugua

SEQ ID NO: 5777 - RNA, 38 nt, Artificial Sequence
  Description of Artificial Sequence:  Enzymatic Nucleic Acid
  misc_feature (18)..(25): n stands for any nucleotide and can be optionally absent
ccuacaaccugaugaggnnnnnnnnccgaaacaacuau

SEQ ID NO: 5778 - RNA, 38 nt, Artificial Sequence
  Description of Artificial Sequence:  Enzymatic Nucleic Acid
  misc_feature (18)..(25): n stands for any nucleotide and can be optionally absent
uacccuaccugaugaggnnnnnnnnccgaaacgacaac

SEQ ID NO: 5779 - RNA, 38 nt, Artificial Sequence
  Description of Artificial Sequence:  Enzymatic Nucleic Acid
  misc_feature (18)..(25): n stands for any nucleotide and can be optionally absent
cuauaccccugaugaggnnnnnnnnccgaaacaacgac

SEQ ID NO: 5780 - RNA, 38 nt, Artificial Sequence
  Description of Artificial Sequence:  Enzymatic Nucleic Acid
  misc_feature (18)..(25): n stands for any nucleotide and can be optionally absent
aaauccuacugaugaggnnnnnnnnccgaaacccuaca

SEQ ID NO: 5781 - RNA, 38 nt, Artificial Sequence
  Description of Artificial Sequence:  Enzymatic Nucleic Acid
  misc_feature (18)..(25): n stands for any nucleotide and can be optionally absent
auaaaucccugaugaggnnnnnnnnccgaaauacccua

SEQ ID NO: 5782 - RNA, 38 nt, Artificial Sequence
  Description of Artificial Sequence:  Enzymatic Nucleic Acid
  misc_feature (18)..(25): n stands for any nucleotide and can be optionally absent
acaucauacugaugaggnnnnnnnnccgaaauccuaua

SEQ ID NO: 5783 - RNA, 38 nt, Artificial Sequence
  Description of Artificial Sequence:  Enzymatic Nucleic Acid
  misc_feature (18)..(25): n stands for any nucleotide and can be optionally absent
cacaucaucugaugaggnnnnnnnnccgaaaauccuau

SEQ ID NO: 5784 - RNA, 38 nt, Artificial Sequence
  Description of Artificial Sequence:  Enzymatic Nucleic Acid
  misc_feature (18)..(25): n stands for any nucleotide and can be optionally absent
ccacaucacugaugaggnnnnnnnnccgaaaaauccua

SEQ ID NO: 5785 - RNA, 38 nt, Artificial Sequence
  Description of Artificial Sequence:  Enzymatic Nucleic Acid
  misc_feature (18)..(25): n stands for any nucleotide and can be optionally absent
ggacucagcugaugaggnnnnnnnnccgaaaccacauc

SEQ ID NO: 5786 - RNA, 38 nt, Artificial Sequence
  Description of Artificial Sequence:  Enzymatic Nucleic Acid
  misc_feature (18)..(25): n stands for any nucleotide and can be optionally absent
cggacucacugaugaggnnnnnnnnccgaaaaccacau

SEQ ID NO: 5787 - RNA, 38 nt, Artificial Sequence
  Description of Artificial Sequence:  Enzymatic Nucleic Acid
  misc_feature (18)..(25): n stands for any nucleotide and can be optionally absent
augagacgcugaugaggnnnnnnnnccgaaacucagaa

SEQ ID NO: 5788 - RNA, 38 nt, Artificial Sequence
  Description of Artificial Sequence:  Enzymatic Nucleic Acid
  misc_feature (18)..(25): n stands for any nucleotide and can be optionally absent
uuccaugacugaugaggnnnnnnnnccgaaacggacuc

SEQ ID NO: 5789 - RNA, 38 nt, Artificial Sequence
  Description of Artificial Sequence:  Enzymatic Nucleic Acid
  misc_feature (18)..(25): n stands for any nucleotide and can be optionally absent
aauuccaucugaugaggnnnnnnnnccgaaagacggac

SEQ ID NO: 5790 - RNA, 38 nt, Artificial Sequence
  Description of Artificial Sequence:  Enzymatic Nucleic Acid
  misc_feature (18)..(25): n stands for any nucleotide and can be optionally absent
gauaguuccugaugaggnnnnnnnnccgaaauuccaug

SEQ ID NO: 5791 - RNA, 38 nt, Artificial Sequence
  Description of Artificial Sequence:  Enzymatic Nucleic Acid
  misc_feature (18)..(25): n stands for any nucleotide and can be optionally absent
ccaacagacugaugaggnnnnnnnnccgaaaguucaau

SEQ ID NO: 5792 - RNA, 38 nt, Artificial Sequence
  Description of Artificial Sequence:  Enzymatic Nucleic Acid
  misc_feature (18)..(25): n stands for any nucleotide and can be optionally absent
cuccaacacugaugaggnnnnnnnnccgaaauaguuca

SEQ ID NO: 5793 - RNA, 38 nt, Artificial Sequence
  Description of Artificial Sequence:  Enzymatic Nucleic Acid
  misc_feature (18)..(25): n stands for any nucleotide and can be optionally absent
uuuucucccugaugaggnnnnnnnnccgaaacagauag

SEQ ID NO: 5794 - RNA, 38 nt, Artificial Sequence
  Description of Artificial Sequence:  Enzymatic Nucleic Acid
  misc_feature (18)..(25): n stands for any nucleotide and can be optionally absent
uuuaagaccugaugaggnnnnnnnnccgaaagcuuuuc

SEQ ID NO: 5795 - RNA, 38 nt, Artificial Sequence
  Description of Artificial Sequence:  Enzymatic Nucleic Acid
  misc_feature (18)..(25): n stands for any nucleotide and can be optionally absent
caauuuaacugaugaggnnnnnnnnccgaaacaagcuu

SEQ ID NO: 5796 - RNA, 38 nt, Artificial Sequence
  Description of Artificial Sequence:  Enzymatic Nucleic Acid
  misc_feature (18)..(25): n stands for any nucleotide and can be optionally absent
uacaauuucugaugaggnnnnnnnnccgaaagacaagc

SEQ ID NO: 5797 - RNA, 38 nt, Artificial Sequence
  Description of Artificial Sequence:  Enzymatic Nucleic Acid
  misc_feature (18)..(25): n stands for any nucleotide and can be optionally absent
guacaauucugaugaggnnnnnnnnccgaaaagacaag

SEQ ID NO: 5798 - RNA, 38 nt, Artificial Sequence
  Description of Artificial Sequence:  Enzymatic Nucleic Acid
  misc_feature (18)..(25): n stands for any nucleotide and can be optionally absent
ugcuguaccugaugaggnnnnnnnnccgaaauuuaaga

SEQ ID NO: 5799 - RNA, 38 nt, Artificial Sequence
  Description of Artificial Sequence:  Enzymatic Nucleic Acid
  misc_feature (18)..(25): n stands for any nucleotide and can be optionally absent
ucuugcugcugaugaggnnnnnnnnccgaaacaauuua

SEQ ID NO: 5800 - RNA, 38 nt, Artificial Sequence
  Description of Artificial Sequence:  Enzymatic Nucleic Acid
  misc_feature (18)..(25): n stands for any nucleotide and can be optionally absent
cccacauucugaugaggnnnnnnnnccgaaaguucagu

SEQ ID NO: 5801 - RNA, 38 nt, Artificial Sequence
  Description of Artificial Sequence:  Enzymatic Nucleic Acid
  misc_feature (18)..(25): n stands for any nucleotide and can be optionally absent
uugaaguccugaugaggnnnnnnnnccgaaauccccac

SEQ ID NO: 5802 - RNA, 38 nt, Artificial Sequence
  Description of Artificial Sequence:  Enzymatic Nucleic Acid
  misc_feature (18)..(25): n stands for any nucleotide and can be optionally absent
cccaguugcugaugaggnnnnnnnnccgaaagucaauc

SEQ ID NO: 5803 - RNA, 38 nt, Artificial Sequence
  Description of Artificial Sequence:  Enzymatic Nucleic Acid
  misc_feature (18)..(25): n stands for any nucleotide and can be optionally absent
ucccaguucugaugaggnnnnnnnnccgaaaagucaau

SEQ ID NO: 5804 - RNA, 38 nt, Artificial Sequence
  Description of Artificial Sequence:  Enzymatic Nucleic Acid
  misc_feature (18)..(25): n stands for any nucleotide and can be optionally absent
aagaagggcugaugaggnnnnnnnnccgaaauucccag

SEQ ID NO: 5805 - RNA, 38 nt, Artificial Sequence
  Description of Artificial Sequence:  Enzymatic Nucleic Acid
  misc_feature (18)..(25): n stands for any nucleotide and can be optionally absent
cuucgaagcugaugaggnnnnnnnnccgaaaggguauu

SEQ ID NO: 5806 - RNA, 38 nt, Artificial Sequence
  Description of Artificial Sequence:  Enzymatic Nucleic Acid
  misc_feature (18)..(25): n stands for any nucleotide and can be optionally absent
gcuucgaacugaugaggnnnnnnnnccgaaaaggguau

SEQ ID NO: 5807 - RNA, 38 nt, Artificial Sequence
  Description of Artificial Sequence:  Enzymatic Nucleic Acid
  misc_feature (18)..(25): n stands for any nucleotide and can be optionally absent
augcuucgcugaugaggnnnnnnnnccgaaagaagggu

SEQ ID NO: 5808 - RNA, 38 nt, Artificial Sequence
  Description of Artificial Sequence:  Enzymatic Nucleic Acid
  misc_feature (18)..(25): n stands for any nucleotide and can be optionally absent
gaugcuuccugaugaggnnnnnnnnccgaaaagaaggg

SEQ ID NO: 5809 - RNA, 38 nt, Artificial Sequence
  Description of Artificial Sequence:  Enzymatic Nucleic Acid
  misc_feature (18)..(25): n stands for any nucleotide and can be optionally absent
cuuaugcucugaugaggnnnnnnnnccgaaaugcuucg

SEQ ID NO: 5810 - RNA, 38 nt, Artificial Sequence
  Description of Artificial Sequence:  Enzymatic Nucleic Acid
  misc_feature (18)..(25): n stands for any nucleotide and can be optionally absent
aaguuucucugaugaggnnnnnnnnccgaaaugcugau

SEQ ID NO: 5811 - RNA, 38 nt, Artificial Sequence
  Description of Artificial Sequence:  Enzymatic Nucleic Acid
  misc_feature (18)..(25): n stands for any nucleotide and can be optionally absent
cgguuuaccugaugaggnnnnnnnnccgaaaguuucuu

SEQ ID NO: 5812 - RNA, 38 nt, Artificial Sequence
  Description of Artificial Sequence:  Enzymatic Nucleic Acid
  misc_feature (18)..(25): n stands for any nucleotide and can be optionally absent
ucucgguucugaugaggnnnnnnnnccgaaacaaguuu

SEQ ID NO: 5813 - RNA, 38 nt, Artificial Sequence
  Description of Artificial Sequence:  Enzymatic Nucleic Acid
  misc_feature (18)..(25): n stands for any nucleotide and can be optionally absent
uggguuuucugaugaggnnnnnnnnccgaaaggucucg

SEQ ID NO: 5814 - RNA, 38 nt, Artificial Sequence
  Description of Artificial Sequence:  Enzymatic Nucleic Acid
  misc_feature (18)..(25): n stands for any nucleotide and can be optionally absent
cacucccacugaugaggnnnnnnnnccgaaacuggguu

SEQ ID NO: 5815 - RNA, 38 nt, Artificial Sequence
  Description of Artificial Sequence:  Enzymatic Nucleic Acid
  misc_feature (18)..(25): n stands for any nucleotide and can be optionally absent
ugcucaaacugaugaggnnnnnnnnccgaaauuucuuc

SEQ ID NO: 5816 - RNA, 38 nt, Artificial Sequence
  Description of Artificial Sequence:  Enzymatic Nucleic Acid
  misc_feature (18)..(25): n stands for any nucleotide and can be optionally absent
gugcucaacugaugaggnnnnnnnnccgaaaauuucuu

SEQ ID NO: 5817 - RNA, 38 nt, Artificial Sequence
  Description of Artificial Sequence:  Enzymatic Nucleic Acid
  misc_feature (18)..(25): n stands for any nucleotide and can be optionally absent
ggugcucacugaugaggnnnnnnnnccgaaaaauuucu

SEQ ID NO: 5818 - RNA, 38 nt, Artificial Sequence
  Description of Artificial Sequence:  Enzymatic Nucleic Acid
  misc_feature (18)..(25): n stands for any nucleotide and can be optionally absent
aggugcuccugaugaggnnnnnnnnccgaaaaaauuuc

SEQ ID NO: 5819 - RNA, 38 nt, Artificial Sequence
  Description of Artificial Sequence:  Enzymatic Nucleic Acid
  misc_feature (18)..(25): n stands for any nucleotide and can be optionally absent
cuauaguucugaugaggnnnnnnnnccgaaaggugcuc

SEQ ID NO: 5820 - RNA, 38 nt, Artificial Sequence
  Description of Artificial Sequence:  Enzymatic Nucleic Acid
  misc_feature (18)..(25): n stands for any nucleotide and can be optionally absent
ucuauagucugaugaggnnnnnnnnccgaaaaggugcu

SEQ ID NO: 5821 - RNA, 38 nt, Artificial Sequence
  Description of Artificial Sequence:  Enzymatic Nucleic Acid
  misc_feature (18)..(25): n stands for any nucleotide and can be optionally absent
accaucuacugaugaggnnnnnnnnccgaaaguuaagg

SEQ ID NO: 5822 - RNA, 38 nt, Artificial Sequence
  Description of Artificial Sequence:  Enzymatic Nucleic Acid
  misc_feature (18)..(25): n stands for any nucleotide and can be optionally absent
acaccauccugaugaggnnnnnnnnccgaaauaguuaa

SEQ ID NO: 5823 - RNA, 38 nt, Artificial Sequence
  Description of Artificial Sequence:  Enzymatic Nucleic Acid
  misc_feature (18)..(25): n stands for any nucleotide and can be optionally absent
cuccgggucugaugaggnnnnnnnnccgaaacaccauc

SEQ ID NO: 5824 - RNA, 38 nt, Artificial Sequence
  Description of Artificial Sequence:  Enzymatic Nucleic Acid
  misc_feature (18)..(25): n stands for any nucleotide and can be optionally absent
agguguaccugaugaggnnnnnnnnccgaaauccuugg

SEQ ID NO: 5825 - RNA, 38 nt, Artificial Sequence
  Description of Artificial Sequence:  Enzymatic Nucleic Acid
  misc_feature (18)..(25): n stands for any nucleotide and can be optionally absent
cacaggugcugaugaggnnnnnnnnccgaaacaauccu

SEQ ID NO: 5826 - RNA, 38 nt, Artificial Sequence
  Description of Artificial Sequence:  Enzymatic Nucleic Acid
  misc_feature (18)..(25): n stands for any nucleotide and can be optionally absent
gcccacugcugaugaggnnnnnnnnccgaaaugcugca

SEQ ID NO: 5827 - RNA, 38 nt, Artificial Sequence
  Description of Artificial Sequence:  Enzymatic Nucleic Acid
  misc_feature (18)..(25): n stands for any nucleotide and can be optionally absent
cccugacacugaugaggnnnnnnnnccgaaaugugcug

SEQ ID NO: 5828 - RNA, 38 nt, Artificial Sequence
  Description of Artificial Sequence:  Enzymatic Nucleic Acid
  misc_feature (18)..(25): n stands for any nucleotide and can be optionally absent
acccugaccugaugaggnnnnnnnnccgaaaaugugcu

SEQ ID NO: 5829 - RNA, 38 nt, Artificial Sequence
  Description of Artificial Sequence:  Enzymatic Nucleic Acid
  misc_feature (18)..(25): n stands for any nucleotide and can be optionally absent
uggacccucugaugaggnnnnnnnnccgaaacaaaugu

SEQ ID NO: 5830 - RNA, 38 nt, Artificial Sequence
  Description of Artificial Sequence:  Enzymatic Nucleic Acid
  misc_feature (18)..(25): n stands for any nucleotide and can be optionally absent
uuuucaugcugaugaggnnnnnnnnccgaaacccugac

SEQ ID NO: 5831 - RNA, 38 nt, Artificial Sequence
  Description of Artificial Sequence:  Enzymatic Nucleic Acid
  misc_feature (18)..(25): n stands for any nucleotide and can be optionally absent
agcaacaacugaugaggnnnnnnnnccgaaagguuuuu

SEQ ID NO: 5832 - RNA, 38 nt, Artificial Sequence
  Description of Artificial Sequence:  Enzymatic Nucleic Acid
  misc_feature (18)..(25): n stands for any nucleotide and can be optionally absent
aagcaacacugaugaggnnnnnnnnccgaaaagguuuu

SEQ ID NO: 5833 - RNA, 38 nt, Artificial Sequence
  Description of Artificial Sequence:  Enzymatic Nucleic Acid
  misc_feature (18)..(25): n stands for any nucleotide and can be optionally absent
aaagcaaccugaugaggnnnnnnnnccgaaaaagguuu

SEQ ID NO: 5834 - RNA, 38 nt, Artificial Sequence
  Description of Artificial Sequence:  Enzymatic Nucleic Acid
  misc_feature (18)..(25): n stands for any nucleotide and can be optionally absent
ccaaaagccugaugaggnnnnnnnnccgaaacaaaagg

SEQ ID NO: 5835 - RNA, 38 nt, Artificial Sequence
  Description of Artificial Sequence:  Enzymatic Nucleic Acid
  misc_feature (18)..(25): n stands for any nucleotide and can be optionally absent
acuuccaacugaugaggnnnnnnnnccgaaagcaacaa

SEQ ID NO: 5836 - RNA, 38 nt, Artificial Sequence
  Description of Artificial Sequence:  Enzymatic Nucleic Acid
  misc_feature (18)..(25): n stands for any nucleotide and can be optionally absent
cacuuccacugaugaggnnnnnnnnccgaaaagcaaca

SEQ ID NO: 5837 - RNA, 38 nt, Artificial Sequence
  Description of Artificial Sequence:  Enzymatic Nucleic Acid
  misc_feature (18)..(25): n stands for any nucleotide and can be optionally absent
ccacuucccugaugaggnnnnnnnnccgaaaaagcaac

SEQ ID NO: 5838 - RNA, 38 nt, Artificial Sequence
  Description of Artificial Sequence:  Enzymatic Nucleic Acid
  misc_feature (18)..(25): n stands for any nucleotide and can be optionally absent
ccaccagacugaugaggnnnnnnnnccgaaauuccaug

SEQ ID NO: 5839 - RNA, 38 nt, Artificial Sequence
  Description of Artificial Sequence:  Enzymatic Nucleic Acid
  misc_feature (18)..(25): n stands for any nucleotide and can be optionally absent
uuccaccacugaugaggnnnnnnnnccgaaagauucca

SEQ ID NO: 5840 - RNA, 38 nt, Artificial Sequence
  Description of Artificial Sequence:  Enzymatic Nucleic Acid
  misc_feature (18)..(25): n stands for any nucleotide and can be optionally absent
gggauucucugaugaggnnnnnnnnccgaaacacgcuc

SEQ ID NO: 5841 - RNA, 38 nt, Artificial Sequence
  Description of Artificial Sequence:  Enzymatic Nucleic Acid
  misc_feature (18)..(25): n stands for any nucleotide and can be optionally absent
uucgcaggcugaugaggnnnnnnnnccgaaauucugac

SEQ ID NO: 5842 - RNA, 38 nt, Artificial Sequence
  Description of Artificial Sequence:  Enzymatic Nucleic Acid
  misc_feature (18)..(25): n stands for any nucleotide and can be optionally absent
aaccaaggcugaugaggnnnnnnnnccgaaacuucgca

SEQ ID NO: 5843 - RNA, 38 nt, Artificial Sequence
  Description of Artificial Sequence:  Enzymatic Nucleic Acid
  misc_feature (18)..(25): n stands for any nucleotide and can be optionally absent
ggguaacccugaugaggnnnnnnnnccgaaagguacuu

SEQ ID NO: 5844 - RNA, 38 nt, Artificial Sequence
  Description of Artificial Sequence:  Enzymatic Nucleic Acid
  misc_feature (18)..(25): n stands for any nucleotide and can be optionally absent
gggugggucugaugaggnnnnnnnnccgaaaccaaggu

SEQ ID NO: 5845 - RNA, 38 nt, Artificial Sequence
  Description of Artificial Sequence:  Enzymatic Nucleic Acid
  misc_feature (18)..(25): n stands for any nucleotide and can be optionally absent
ggggugggcugaugaggnnnnnnnnccgaaaaccaagg

SEQ ID NO: 5846 - RNA, 38 nt, Artificial Sequence
  Description of Artificial Sequence:  Enzymatic Nucleic Acid
  misc_feature (18)..(25): n stands for any nucleotide and can be optionally absent
uaccauuucugaugaggnnnnnnnnccgaaauuucugg

SEQ ID NO: 5847 - RNA, 38 nt, Artificial Sequence
  Description of Artificial Sequence:  Enzymatic Nucleic Acid
  misc_feature (18)..(25): n stands for any nucleotide and can be optionally absent
cauuuuuacugaugaggnnnnnnnnccgaaaccauuuu

SEQ ID NO: 5848 - RNA, 38 nt, Artificial Sequence
  Description of Artificial Sequence:  Enzymatic Nucleic Acid
  misc_feature (18)..(25): n stands for any nucleotide and can be optionally absent
uccauuuucugaugaggnnnnnnnnccgaaauaccauu

SEQ ID NO: 5849 - RNA, 38 nt, Artificial Sequence
  Description of Artificial Sequence:  Enzymatic Nucleic Acid
  misc_feature (18)..(25): n stands for any nucleotide and can be optionally absent
ucaaggggcugaugaggnnnnnnnnccgaaauuccauu

SEQ ID NO: 5850 - RNA, 38 nt, Artificial Sequence
  Description of Artificial Sequence:  Enzymatic Nucleic Acid
  misc_feature (18)..(25): n stands for any nucleotide and can be optionally absent
uuggacuccugaugaggnnnnnnnnccgaaagggguau

SEQ ID NO: 5851 - RNA, 38 nt, Artificial Sequence
  Description of Artificial Sequence:  Enzymatic Nucleic Acid
  misc_feature (18)..(25): n stands for any nucleotide and can be optionally absent
ugugauugcugaugaggnnnnnnnnccgaaacucaagg

SEQ ID NO: 5852 - RNA, 38 nt, Artificial Sequence
  Description of Artificial Sequence:  Enzymatic Nucleic Acid
  misc_feature (18)..(25): n stands for any nucleotide and can be optionally absent
aauugugucugaugaggnnnnnnnnccgaaauuggacu

SEQ ID NO: 5853 - RNA, 38 nt, Artificial Sequence
  Description of Artificial Sequence:  Enzymatic Nucleic Acid
  misc_feature (18)..(25): n stands for any nucleotide and can be optionally absent
cccgcuuucugaugaggnnnnnnnnccgaaauugugug

SEQ ID NO: 5854 - RNA, 38 nt, Artificial Sequence
  Description of Artificial Sequence:  Enzymatic Nucleic Acid
  misc_feature (18)..(25): n stands for any nucleotide and can be optionally absent
ccccgcuucugaugaggnnnnnnnnccgaaaauugugu

SEQ ID NO: 5855 - RNA, 38 nt, Artificial Sequence
  Description of Artificial Sequence:  Enzymatic Nucleic Acid
  misc_feature (18)..(25): n stands for any nucleotide and can be optionally absent
aucgucagcugaugaggnnnnnnnnccgaaacaugccc

SEQ ID NO: 5856 - RNA, 38 nt, Artificial Sequence
  Description of Artificial Sequence:  Enzymatic Nucleic Acid
  misc_feature (18)..(25): n stands for any nucleotide and can be optionally absent
acuuccaucugaugaggnnnnnnnnccgaaaucgucag

SEQ ID NO: 5857 - RNA, 38 nt, Artificial Sequence
  Description of Artificial Sequence:  Enzymatic Nucleic Acid
  misc_feature (18)..(25): n stands for any nucleotide and can be optionally absent
cacuuccacugaugaggnnnnnnnnccgaaaaucguca

SEQ ID NO: 5858 - RNA, 38 nt, Artificial Sequence
  Description of Artificial Sequence:  Enzymatic Nucleic Acid
  misc_feature (18)..(25): n stands for any nucleotide and can be optionally absent
gacagugucugaugaggnnnnnnnnccgaaauuuccug

SEQ ID NO: 5859 - RNA, 38 nt, Artificial Sequence
  Description of Artificial Sequence:  Enzymatic Nucleic Acid
  misc_feature (18)..(25): n stands for any nucleotide and can be optionally absent
ugacagugcugaugaggnnnnnnnnccgaaaauuuccu

SEQ ID NO: 5860 - RNA, 38 nt, Artificial Sequence
  Description of Artificial Sequence:  Enzymatic Nucleic Acid
  misc_feature (18)..(25): n stands for any nucleotide and can be optionally absent
guaaggaucugaugaggnnnnnnnnccgaaacagugua

SEQ ID NO: 5861 - RNA, 38 nt, Artificial Sequence
  Description of Artificial Sequence:  Enzymatic Nucleic Acid
  misc_feature (18)..(25): n stands for any nucleotide and can be optionally absent
uugguaagcugaugaggnnnnnnnnccgaaaugacagu

SEQ ID NO: 5862 - RNA, 38 nt, Artificial Sequence
  Description of Artificial Sequence:  Enzymatic Nucleic Acid
  misc_feature (18)..(25): n stands for any nucleotide and can be optionally absent
ggauuggucugaugaggnnnnnnnnccgaaaggaugac

SEQ ID NO: 5863 - RNA, 38 nt, Artificial Sequence
  Description of Artificial Sequence:  Enzymatic Nucleic Acid
  misc_feature (18)..(25): n stands for any nucleotide and can be optionally absent
gggauuggcugaugaggnnnnnnnnccgaaaaggauga

SEQ ID NO: 5864 - RNA, 38 nt, Artificial Sequence
  Description of Artificial Sequence:  Enzymatic Nucleic Acid
  misc_feature (18)..(25): n stands for any nucleotide and can be optionally absent
ugaaauggcugaugaggnnnnnnnnccgaaauugguaa

SEQ ID NO: 5865 - RNA, 38 nt, Artificial Sequence
  Description of Artificial Sequence:  Enzymatic Nucleic Acid
  misc_feature (18)..(25): n stands for any nucleotide and can be optionally absent
uccuuugacugaugaggnnnnnnnnccgaaaugggauu

SEQ ID NO: 5866 - RNA, 38 nt, Artificial Sequence
  Description of Artificial Sequence:  Enzymatic Nucleic Acid
  misc_feature (18)..(25): n stands for any nucleotide and can be optionally absent
cuccuuugcugaugaggnnnnnnnnccgaaaaugggau

SEQ ID NO: 5867 - RNA, 38 nt, Artificial Sequence
  Description of Artificial Sequence:  Enzymatic Nucleic Acid
  misc_feature (18)..(25): n stands for any nucleotide and can be optionally absent
ucuccuuucugaugaggnnnnnnnnccgaaaaauggga

SEQ ID NO: 5868 - RNA, 38 nt, Artificial Sequence
  Description of Artificial Sequence:  Enzymatic Nucleic Acid
  misc_feature (18)..(25): n stands for any nucleotide and can be optionally absent
accagagacugaugaggnnnnnnnnccgaaaccacaug

SEQ ID NO: 5869 - RNA, 38 nt, Artificial Sequence
  Description of Artificial Sequence:  Enzymatic Nucleic Acid
  misc_feature (18)..(25): n stands for any nucleotide and can be optionally absent
caaccagacugaugaggnnnnnnnnccgaaagaccaca

SEQ ID NO: 5870 - RNA, 38 nt, Artificial Sequence
  Description of Artificial Sequence:  Enzymatic Nucleic Acid
  misc_feature (18)..(25): n stands for any nucleotide and can be optionally absent
cacaaccacugaugaggnnnnnnnnccgaaagagacca

SEQ ID NO: 5871 - RNA, 38 nt, Artificial Sequence
  Description of Artificial Sequence:  Enzymatic Nucleic Acid
  misc_feature (18)..(25): n stands for any nucleotide and can be optionally absent
acauacaccugaugaggnnnnnnnnccgaaaccagaga

SEQ ID NO: 5872 - RNA, 38 nt, Artificial Sequence
  Description of Artificial Sequence:  Enzymatic Nucleic Acid
  misc_feature (18)..(25): n stands for any nucleotide and can be optionally absent
gugggacacugaugaggnnnnnnnnccgaaacacaacc

SEQ ID NO: 5873 - RNA, 38 nt, Artificial Sequence
  Description of Artificial Sequence:  Enzymatic Nucleic Acid
  misc_feature (18)..(25): n stands for any nucleotide and can be optionally absent
ugggguggcugaugaggnnnnnnnnccgaaacauacac

SEQ ID NO: 5874 - RNA, 38 nt, Artificial Sequence
  Description of Artificial Sequence:  Enzymatic Nucleic Acid
  misc_feature (18)..(25): n stands for any nucleotide and can be optionally absent
uucucacccugaugaggnnnnnnnnccgaaaucugggg

SEQ ID NO: 5875 - RNA, 38 nt, Artificial Sequence
  Description of Artificial Sequence:  Enzymatic Nucleic Acid
  misc_feature (18)..(25): n stands for any nucleotide and can be optionally absent
agauuagacugaugaggnnnnnnnnccgaaauuucuca

SEQ ID NO: 5876 - RNA, 38 nt, Artificial Sequence
  Description of Artificial Sequence:  Enzymatic Nucleic Acid
  misc_feature (18)..(25): n stands for any nucleotide and can be optionally absent
agagauuacugaugaggnnnnnnnnccgaaagauuucu

SEQ ID NO: 5877 - RNA, 38 nt, Artificial Sequence
  Description of Artificial Sequence:  Enzymatic Nucleic Acid
  misc_feature (18)..(25): n stands for any nucleotide and can be optionally absent
ggagagaucugaugaggnnnnnnnnccgaaagagauuu

SEQ ID NO: 5878 - RNA, 38 nt, Artificial Sequence
  Description of Artificial Sequence:  Enzymatic Nucleic Acid
  misc_feature (18)..(25): n stands for any nucleotide and can be optionally absent
acaggagacugaugaggnnnnnnnnccgaaauuagaga

SEQ ID NO: 5879 - RNA, 38 nt, Artificial Sequence
  Description of Artificial Sequence:  Enzymatic Nucleic Acid
  misc_feature (18)..(25): n stands for any nucleotide and can be optionally absent
ccacaggacugaugaggnnnnnnnnccgaaagauuaga

SEQ ID NO: 5880 - RNA, 38 nt, Artificial Sequence
  Description of Artificial Sequence:  Enzymatic Nucleic Acid
  misc_feature (18)..(25): n stands for any nucleotide and can be optionally absent
auccacagcugaugaggnnnnnnnnccgaaagagauua

SEQ ID NO: 5881 - RNA, 38 nt, Artificial Sequence
  Description of Artificial Sequence:  Enzymatic Nucleic Acid
  misc_feature (18)..(25): n stands for any nucleotide and can be optionally absent
cugguaggcugaugaggnnnnnnnnccgaaauccacag

SEQ ID NO: 5882 - RNA, 38 nt, Artificial Sequence
  Description of Artificial Sequence:  Enzymatic Nucleic Acid
  misc_feature (18)..(25): n stands for any nucleotide and can be optionally absent
acugguagcugaugaggnnnnnnnnccgaaaauccaca

SEQ ID NO: 5883 - RNA, 38 nt, Artificial Sequence
  Description of Artificial Sequence:  Enzymatic Nucleic Acid
  misc_feature (18)..(25): n stands for any nucleotide and can be optionally absent
cguacuggcugaugaggnnnnnnnnccgaaaggaaucc

SEQ ID NO: 5884 - RNA, 38 nt, Artificial Sequence
  Description of Artificial Sequence:  Enzymatic Nucleic Acid
  misc_feature (18)..(25): n stands for any nucleotide and can be optionally absent
uggugccgcugaugaggnnnnnnnnccgaaacugguag

SEQ ID NO: 5885 - RNA, 38 nt, Artificial Sequence
  Description of Artificial Sequence:  Enzymatic Nucleic Acid
  misc_feature (18)..(25): n stands for any nucleotide and can be optionally absent
cagcguuucugaugaggnnnnnnnnccgaaaguggugc

SEQ ID NO: 5886 - RNA, 38 nt, Artificial Sequence
  Description of Artificial Sequence:  Enzymatic Nucleic Acid
  misc_feature (18)..(25): n stands for any nucleotide and can be optionally absent
auagaccgcugaugaggnnnnnnnnccgaaacauguca

SEQ ID NO: 5887 - RNA, 38 nt, Artificial Sequence
  Description of Artificial Sequence:  Enzymatic Nucleic Acid
  misc_feature (18)..(25): n stands for any nucleotide and can be optionally absent
auggcauacugaugaggnnnnnnnnccgaaaccguaca

SEQ ID NO: 5888 - RNA, 38 nt, Artificial Sequence
  Description of Artificial Sequence:  Enzymatic Nucleic Acid
  misc_feature (18)..(25): n stands for any nucleotide and can be optionally absent
gaauggcacugaugaggnnnnnnnnccgaaagaccgua

SEQ ID NO: 5889 - RNA, 38 nt, Artificial Sequence
  Description of Artificial Sequence:  Enzymatic Nucleic Acid
  misc_feature (18)..(25): n stands for any nucleotide and can be optionally absent
gggggaggcugaugaggnnnnnnnnccgaaauggcaua

SEQ ID NO: 5890 - RNA, 38 nt, Artificial Sequence
  Description of Artificial Sequence:  Enzymatic Nucleic Acid
  misc_feature (18)..(25): n stands for any nucleotide and can be optionally absent
cgggggagcugaugaggnnnnnnnnccgaaaauggcau

SEQ ID NO: 5891 - RNA, 38 nt, Artificial Sequence
  Description of Artificial Sequence:  Enzymatic Nucleic Acid
  misc_feature (18)..(25): n stands for any nucleotide and can be optionally absent
augcggggcugaugaggnnnnnnnnccgaaaggaaugg

SEQ ID NO: 5892 - RNA, 38 nt, Artificial Sequence
  Description of Artificial Sequence:  Enzymatic Nucleic Acid
  misc_feature (18)..(25): n stands for any nucleotide and can be optionally absent
guggaugucugaugaggnnnnnnnnccgaaaugcgggg

SEQ ID NO: 5893 - RNA, 38 nt, Artificial Sequence
  Description of Artificial Sequence:  Enzymatic Nucleic Acid
  misc_feature (18)..(25): n stands for any nucleotide and can be optionally absent
uaccagugcugaugaggnnnnnnnnccgaaaugugaug

SEQ ID NO: 5894 - RNA, 38 nt, Artificial Sequence
  Description of Artificial Sequence:  Enzymatic Nucleic Acid
  misc_feature (18)..(25): n stands for any nucleotide and can be optionally absent
acugccaacugaugaggnnnnnnnnccgaaaccagugg

SEQ ID NO: 5895 - RNA, 38 nt, Artificial Sequence
  Description of Artificial Sequence:  Enzymatic Nucleic Acid
  misc_feature (18)..(25): n stands for any nucleotide and can be optionally absent
caacugcccugaugaggnnnnnnnnccgaaauaccagu

SEQ ID NO: 5896 - RNA, 38 nt, Artificial Sequence
  Description of Artificial Sequence:  Enzymatic Nucleic Acid
  misc_feature (18)..(25): n stands for any nucleotide and can be optionally absent
cuuccucccugaugaggnnnnnnnnccgaaacugccaa

SEQ ID NO: 5897 - RNA, 38 nt, Artificial Sequence
  Description of Artificial Sequence:  Enzymatic Nucleic Acid
  misc_feature (18)..(25): n stands for any nucleotide and can be optionally absent
gucacugacugaugaggnnnnnnnnccgaaacagcuug

SEQ ID NO: 5898 - RNA, 38 nt, Artificial Sequence
  Description of Artificial Sequence:  Enzymatic Nucleic Acid
  misc_feature (18)..(25): n stands for any nucleotide and can be optionally absent
uugucacucugaugaggnnnnnnnnccgaaagacagcu

SEQ ID NO: 5899 - RNA, 38 nt, Artificial Sequence
  Description of Artificial Sequence:  Enzymatic Nucleic Acid
  misc_feature (18)..(25): n stands for any nucleotide and can be optionally absent
cacaagggcugaugaggnnnnnnnnccgaaauggguuu

SEQ ID NO: 5900 - RNA, 38 nt, Artificial Sequence
  Description of Artificial Sequence:  Enzymatic Nucleic Acid
  misc_feature (18)..(25): n stands for any nucleotide and can be optionally absent
uucuucaccugaugaggnnnnnnnnccgaaaggguaug

SEQ ID NO: 5901 - RNA, 38 nt, Artificial Sequence
  Description of Artificial Sequence:  Enzymatic Nucleic Acid
  misc_feature (18)..(25): n stands for any nucleotide and can be optionally absent
cucccuggcugaugaggnnnnnnnnccgaaaguccucc

SEQ ID NO: 5902 - RNA, 38 nt, Artificial Sequence
  Description of Artificial Sequence:  Enzymatic Nucleic Acid
  misc_feature (18)..(25): n stands for any nucleotide and can be optionally absent
ccucccugcugaugaggnnnnnnnnccgaaaaguccuc

SEQ ID NO: 5903 - RNA, 38 nt, Artificial Sequence
  Description of Artificial Sequence:  Enzymatic Nucleic Acid
  misc_feature (18)..(25): n stands for any nucleotide and can be optionally absent
uucaauuucugaugaggnnnnnnnnccgaaauuuccuc

SEQ ID NO: 5904 - RNA, 38 nt, Artificial Sequence
  Description of Artificial Sequence:  Enzymatic Nucleic Acid
  misc_feature (18)..(25): n stands for any nucleotide and can be optionally absent
uuaacuuccugaugaggnnnnnnnnccgaaauuuuauu

SEQ ID NO: 5905 - RNA, 38 nt, Artificial Sequence
  Description of Artificial Sequence:  Enzymatic Nucleic Acid
  misc_feature (18)..(25): n stands for any nucleotide and can be optionally absent
uuuuuauucugaugaggnnnnnnnnccgaaacuucaau

SEQ ID NO: 5906 - RNA, 38 nt, Artificial Sequence
  Description of Artificial Sequence:  Enzymatic Nucleic Acid
  misc_feature (18)..(25): n stands for any nucleotide and can be optionally absent
auuuuuaucugaugaggnnnnnnnnccgaaaacuucaa

SEQ ID NO: 5907 - RNA, 38 nt, Artificial Sequence
  Description of Artificial Sequence:  Enzymatic Nucleic Acid
  misc_feature (18)..(25): n stands for any nucleotide and can be optionally absent
uugauuuucugaugaggnnnnnnnnccgaaauuaacuu

SEQ ID NO: 5908 - RNA, 38 nt, Artificial Sequence
  Description of Artificial Sequence:  Enzymatic Nucleic Acid
  misc_feature (18)..(25): n stands for any nucleotide and can be optionally absent
agcaaauucugaugaggnnnnnnnnccgaaauuuuuau

SEQ ID NO: 5909 - RNA, 38 nt, Artificial Sequence
  Description of Artificial Sequence:  Enzymatic Nucleic Acid
  misc_feature (18)..(25): n stands for any nucleotide and can be optionally absent
uuagagcacugaugaggnnnnnnnnccgaaauugauuu

SEQ ID NO: 5910 - RNA, 38 nt, Artificial Sequence
  Description of Artificial Sequence:  Enzymatic Nucleic Acid
  misc_feature (18)..(25): n stands for any nucleotide and can be optionally absent
auuagagccugaugaggnnnnnnnnccgaaaauugauu

SEQ ID NO: 5911 - RNA, 38 nt, Artificial Sequence
  Description of Artificial Sequence:  Enzymatic Nucleic Acid
  misc_feature (18)..(25): n stands for any nucleotide and can be optionally absent
uucaauuacugaugaggnnnnnnnnccgaaagcaaauu

SEQ ID NO: 5912 - RNA, 38 nt, Artificial Sequence
  Description of Artificial Sequence:  Enzymatic Nucleic Acid
  misc_feature (18)..(25): n stands for any nucleotide and can be optionally absent
ccuucaaucugaugaggnnnnnnnnccgaaagagcaaa

SEQ ID NO: 5913 - RNA, 38 nt, Artificial Sequence
  Description of Artificial Sequence:  Enzymatic Nucleic Acid
  misc_feature (18)..(25): n stands for any nucleotide and can be optionally absent
uuuccuuccugaugaggnnnnnnnnccgaaauuagagc

SEQ ID NO: 5914 - RNA, 38 nt, Artificial Sequence
  Description of Artificial Sequence:  Enzymatic Nucleic Acid
  misc_feature (18)..(25): n stands for any nucleotide and can be optionally absent
aggguacucugaugaggnnnnnnnnccgaaacaguuuu

SEQ ID NO: 5915 - RNA, 38 nt, Artificial Sequence
  Description of Artificial Sequence:  Enzymatic Nucleic Acid
  misc_feature (18)..(25): n stands for any nucleotide and can be optionally absent
aacaagggcugaugaggnnnnnnnnccgaaacuuacag

SEQ ID NO: 5916 - RNA, 38 nt, Artificial Sequence
  Description of Artificial Sequence:  Enzymatic Nucleic Acid
  misc_feature (18)..(25): n stands for any nucleotide and can be optionally absent
uggauaaccugaugaggnnnnnnnnccgaaaggguacu

SEQ ID NO: 5917 - RNA, 38 nt, Artificial Sequence
  Description of Artificial Sequence:  Enzymatic Nucleic Acid
  misc_feature (18)..(25): n stands for any nucleotide and can be optionally absent
gcuuggaucugaugaggnnnnnnnnccgaaacaagggu

SEQ ID NO: 5918 - RNA, 38 nt, Artificial Sequence
  Description of Artificial Sequence:  Enzymatic Nucleic Acid
  misc_feature (18)..(25): n stands for any nucleotide and can be optionally absent
cgcuuggacugaugaggnnnnnnnnccgaaaacaaggg

SEQ ID NO: 5919 - RNA, 38 nt, Artificial Sequence
  Description of Artificial Sequence:  Enzymatic Nucleic Acid
  misc_feature (18)..(25): n stands for any nucleotide and can be optionally absent
gccgcuugcugaugaggnnnnnnnnccgaaauaacaag

SEQ ID NO: 5920 - RNA, 38 nt, Artificial Sequence
  Description of Artificial Sequence:  Enzymatic Nucleic Acid
  misc_feature (18)..(25): n stands for any nucleotide and can be optionally absent
acaaagcucugaugaggnnnnnnnnccgaaacacauuu

SEQ ID NO: 5921 - RNA, 38 nt, Artificial Sequence
  Description of Artificial Sequence:  Enzymatic Nucleic Acid
  misc_feature (18)..(25): n stands for any nucleotide and can be optionally absent
uuuguacacugaugaggnnnnnnnnccgaaagcugaca

SEQ ID NO: 5922 - RNA, 38 nt, Artificial Sequence
  Description of Artificial Sequence:  Enzymatic Nucleic Acid
  misc_feature (18)..(25): n stands for any nucleotide and can be optionally absent
auuuguaccugaugaggnnnnnnnnccgaaaagcugac

SEQ ID NO: 5923 - RNA, 38 nt, Artificial Sequence
  Description of Artificial Sequence:  Enzymatic Nucleic Acid
  misc_feature (18)..(25): n stands for any nucleotide and can be optionally absent
cacauuugcugaugaggnnnnnnnnccgaaacaaagcu

SEQ ID NO: 5924 - RNA, 38 nt, Artificial Sequence
  Description of Artificial Sequence:  Enzymatic Nucleic Acid
  misc_feature (18)..(25): n stands for any nucleotide and can be optionally absent
acuuuguucugaugaggnnnnnnnnccgaaaccgcuuc

SEQ ID NO: 5925 - RNA, 38 nt, Artificial Sequence
  Description of Artificial Sequence:  Enzymatic Nucleic Acid
  misc_feature (18)..(25): n stands for any nucleotide and can be optionally absent
ccucuccccugaugaggnnnnnnnnccgaaacuuuguu

SEQ ID NO: 5926 - RNA, 38 nt, Artificial Sequence
  Description of Artificial Sequence:  Enzymatic Nucleic Acid
  misc_feature (18)..(25): n stands for any nucleotide and can be optionally absent
uggaaggacugaugaggnnnnnnnnccgaaaucacccu

SEQ ID NO: 5927 - RNA, 38 nt, Artificial Sequence
  Description of Artificial Sequence:  Enzymatic Nucleic Acid
  misc_feature (18)..(25): n stands for any nucleotide and can be optionally absent
cguggaagcugaugaggnnnnnnnnccgaaagaucacc

SEQ ID NO: 5928 - RNA, 38 nt, Artificial Sequence
  Description of Artificial Sequence:  Enzymatic Nucleic Acid
  misc_feature (18)..(25): n stands for any nucleotide and can be optionally absent
ucacguggcugaugaggnnnnnnnnccgaaaggagauc

SEQ ID NO: 5929 - RNA, 38 nt, Artificial Sequence
  Description of Artificial Sequence:  Enzymatic Nucleic Acid
  misc_feature (18)..(25): n stands for any nucleotide and can be optionally absent
gucacgugcugaugaggnnnnnnnnccgaaaaggagau

SEQ ID NO: 5930 - RNA, 38 nt, Artificial Sequence
  Description of Artificial Sequence:  Enzymatic Nucleic Acid
  misc_feature (18)..(25): n stands for any nucleotide and can be optionally absent
aauuucagcugaugaggnnnnnnnnccgaaaccccugg

SEQ ID NO: 5931 - RNA, 38 nt, Artificial Sequence
  Description of Artificial Sequence:  Enzymatic Nucleic Acid
  misc_feature (18)..(25): n stands for any nucleotide and can be optionally absent
ugcaaagucugaugaggnnnnnnnnccgaaauuucagg

SEQ ID NO: 5932 - RNA, 38 nt, Artificial Sequence
  Description of Artificial Sequence:  Enzymatic Nucleic Acid
  misc_feature (18)..(25): n stands for any nucleotide and can be optionally absent
uugcaaagcugaugaggnnnnnnnnccgaaaauuucag

SEQ ID NO: 5933 - RNA, 38 nt, Artificial Sequence
  Description of Artificial Sequence:  Enzymatic Nucleic Acid
  misc_feature (18)..(25): n stands for any nucleotide and can be optionally absent
agguugcacugaugaggnnnnnnnnccgaaaguaauuu

SEQ ID NO: 5934 - RNA, 38 nt, Artificial Sequence
  Description of Artificial Sequence:  Enzymatic Nucleic Acid
  misc_feature (18)..(25): n stands for any nucleotide and can be optionally absent
cagguugccugaugaggnnnnnnnnccgaaaaguaauu

SEQ ID NO: 5935 - RNA, 38 nt, Artificial Sequence
  Description of Artificial Sequence:  Enzymatic Nucleic Acid
  misc_feature (18)..(25): n stands for any nucleotide and can be optionally absent
accacaaacugaugaggnnnnnnnnccgaaacacgcuc

SEQ ID NO: 5936 - RNA, 38 nt, Artificial Sequence
  Description of Artificial Sequence:  Enzymatic Nucleic Acid
  misc_feature (18)..(25): n stands for any nucleotide and can be optionally absent
gcaccacacugaugaggnnnnnnnnccgaaagacacgc

SEQ ID NO: 5937 - RNA, 38 nt, Artificial Sequence
  Description of Artificial Sequence:  Enzymatic Nucleic Acid
  misc_feature (18)..(25): n stands for any nucleotide and can be optionally absent
ugcaccaccugaugaggnnnnnnnnccgaaaagacacg

SEQ ID NO: 5938 - RNA, 38 nt, Artificial Sequence
  Description of Artificial Sequence:  Enzymatic Nucleic Acid
  misc_feature (18)..(25): n stands for any nucleotide and can be optionally absent
caaacguacugaugaggnnnnnnnnccgaaaucugucu

SEQ ID NO: 5939 - RNA, 38 nt, Artificial Sequence
  Description of Artificial Sequence:  Enzymatic Nucleic Acid
  misc_feature (18)..(25): n stands for any nucleotide and can be optionally absent
cucaaacgcugaugaggnnnnnnnnccgaaagaucugu

SEQ ID NO: 5940 - RNA, 38 nt, Artificial Sequence
  Description of Artificial Sequence:  Enzymatic Nucleic Acid
  misc_feature (18)..(25): n stands for any nucleotide and can be optionally absent
gguucucacugaugaggnnnnnnnnccgaaacguagau

SEQ ID NO: 5941 - RNA, 38 nt, Artificial Sequence
  Description of Artificial Sequence:  Enzymatic Nucleic Acid
  misc_feature (18)..(25): n stands for any nucleotide and can be optionally absent
agguucuccugaugaggnnnnnnnnccgaaaacguaga

SEQ ID NO: 5942 - RNA, 38 nt, Artificial Sequence
  Description of Artificial Sequence:  Enzymatic Nucleic Acid
  misc_feature (18)..(25): n stands for any nucleotide and can be optionally absent
uaccaugucugaugaggnnnnnnnnccgaaagguucuc

SEQ ID NO: 5943 - RNA, 38 nt, Artificial Sequence
  Description of Artificial Sequence:  Enzymatic Nucleic Acid
  misc_feature (18)..(25): n stands for any nucleotide and can be optionally absent
caagcuugcugaugaggnnnnnnnnccgaaaccaugug

SEQ ID NO: 5944 - RNA, 38 nt, Artificial Sequence
  Description of Artificial Sequence:  Enzymatic Nucleic Acid
  misc_feature (18)..(25): n stands for any nucleotide and can be optionally absent
ugugggcccugaugaggnnnnnnnnccgaaagcuugua

SEQ ID NO: 5945 - RNA, 38 nt, Artificial Sequence
  Description of Artificial Sequence:  Enzymatic Nucleic Acid
  misc_feature (18)..(25): n stands for any nucleotide and can be optionally absent
gauuggcacugaugaggnnnnnnnnccgaaaggcugug

SEQ ID NO: 5946 - RNA, 38 nt, Artificial Sequence
  Description of Artificial Sequence:  Enzymatic Nucleic Acid
  misc_feature (18)..(25): n stands for any nucleotide and can be optionally absent
cccacaugcugaugaggnnnnnnnnccgaaauuggcag

SEQ ID NO: 5947 - RNA, 38 nt, Artificial Sequence
  Description of Artificial Sequence:  Enzymatic Nucleic Acid
  misc_feature (18)..(25): n stands for any nucleotide and can be optionally absent
gugugggccugaugaggnnnnnnnnccgaaacucuccc

SEQ ID NO: 5948 - RNA, 38 nt, Artificial Sequence
  Description of Artificial Sequence:  Enzymatic Nucleic Acid
  misc_feature (18)..(25): n stands for any nucleotide and can be optionally absent
uucuugcacugaugaggnnnnnnnnccgaaacaggugu

SEQ ID NO: 5949 - RNA, 38 nt, Artificial Sequence
  Description of Artificial Sequence:  Enzymatic Nucleic Acid
  misc_feature (18)..(25): n stands for any nucleotide and can be optionally absent
guucuugccugaugaggnnnnnnnnccgaaaacaggug

SEQ ID NO: 5950 - RNA, 38 nt, Artificial Sequence
  Description of Artificial Sequence:  Enzymatic Nucleic Acid
  misc_feature (18)..(25): n stands for any nucleotide and can be optionally absent
gaguaucccugaugaggnnnnnnnnccgaaaguucuug

SEQ ID NO: 5951 - RNA, 38 nt, Artificial Sequence
  Description of Artificial Sequence:  Enzymatic Nucleic Acid
  misc_feature (18)..(25): n stands for any nucleotide and can be optionally absent
ccaaagagcugaugaggnnnnnnnnccgaaauccaagu

SEQ ID NO: 5952 - RNA, 38 nt, Artificial Sequence
  Description of Artificial Sequence:  Enzymatic Nucleic Acid
  misc_feature (18)..(25): n stands for any nucleotide and can be optionally absent
uuuccaaacugaugaggnnnnnnnnccgaaaguaucca

SEQ ID NO: 5953 - RNA, 38 nt, Artificial Sequence
  Description of Artificial Sequence:  Enzymatic Nucleic Acid
  misc_feature (18)..(25): n stands for any nucleotide and can be optionally absent
aauuuccacugaugaggnnnnnnnnccgaaagaguauc

SEQ ID NO: 5954 - RNA, 38 nt, Artificial Sequence
  Description of Artificial Sequence:  Enzymatic Nucleic Acid
  misc_feature (18)..(25): n stands for any nucleotide and can be optionally absent
caauuucccugaugaggnnnnnnnnccgaaaagaguau

SEQ ID NO: 5955 - RNA, 38 nt, Artificial Sequence
  Description of Artificial Sequence:  Enzymatic Nucleic Acid
  misc_feature (18)..(25): n stands for any nucleotide and can be optionally absent
uggcauuccugaugaggnnnnnnnnccgaaauuuccaa

SEQ ID NO: 5956 - RNA, 38 nt, Artificial Sequence
  Description of Artificial Sequence:  Enzymatic Nucleic Acid
  misc_feature (18)..(25): n stands for any nucleotide and can be optionally absent
uauuagagcugaugaggnnnnnnnnccgaaacauggug

SEQ ID NO: 5957 - RNA, 38 nt, Artificial Sequence
  Description of Artificial Sequence:  Enzymatic Nucleic Acid
  misc_feature (18)..(25): n stands for any nucleotide and can be optionally absent
cuauuagacugaugaggnnnnnnnnccgaaaacauggu

SEQ ID NO: 5958 - RNA, 38 nt, Artificial Sequence
  Description of Artificial Sequence:  Enzymatic Nucleic Acid
  misc_feature (18)..(25): n stands for any nucleotide and can be optionally absent
ugcuauuacugaugaggnnnnnnnnccgaaagaacaug

SEQ ID NO: 5959 - RNA, 38 nt, Artificial Sequence
  Description of Artificial Sequence:  Enzymatic Nucleic Acid
  misc_feature (18)..(25): n stands for any nucleotide and can be optionally absent
ugugcuaucugaugaggnnnnnnnnccgaaagagaaca

SEQ ID NO: 5960 - RNA, 38 nt, Artificial Sequence
  Description of Artificial Sequence:  Enzymatic Nucleic Acid
  misc_feature (18)..(25): n stands for any nucleotide and can be optionally absent
auuugugccugaugaggnnnnnnnnccgaaauuagaga

SEQ ID NO: 5961 - RNA, 38 nt, Artificial Sequence
  Description of Artificial Sequence:  Enzymatic Nucleic Acid
  misc_feature (18)..(25): n stands for any nucleotide and can be optionally absent
augaucaacugaugaggnnnnnnnnccgaaaugucauu

SEQ ID NO: 5962 - RNA, 38 nt, Artificial Sequence
  Description of Artificial Sequence:  Enzymatic Nucleic Acid
  misc_feature (18)..(25): n stands for any nucleotide and can be optionally absent
caugaucacugaugaggnnnnnnnnccgaaaaugucau

SEQ ID NO: 5963 - RNA, 38 nt, Artificial Sequence
  Description of Artificial Sequence:  Enzymatic Nucleic Acid
  misc_feature (18)..(25): n stands for any nucleotide and can be optionally absent
ccaugauccugaugaggnnnnnnnnccgaaaaauguca

SEQ ID NO: 5964 - RNA, 38 nt, Artificial Sequence
  Description of Artificial Sequence:  Enzymatic Nucleic Acid
  misc_feature (18)..(25): n stands for any nucleotide and can be optionally absent
agcuccaucugaugaggnnnnnnnnccgaaaucaaaau

SEQ ID NO: 5965 - RNA, 38 nt, Artificial Sequence
  Description of Artificial Sequence:  Enzymatic Nucleic Acid
  misc_feature (18)..(25): n stands for any nucleotide and can be optionally absent
gcauucuucugaugaggnnnnnnnnccgaaagcuccau

SEQ ID NO: 5966 - RNA, 38 nt, Artificial Sequence
  Description of Artificial Sequence:  Enzymatic Nucleic Acid
  misc_feature (18)..(25): n stands for any nucleotide and can be optionally absent
ugcauucucugaugaggnnnnnnnnccgaaaagcucca

SEQ ID NO: 5967 - RNA, 38 nt, Artificial Sequence
  Description of Artificial Sequence:  Enzymatic Nucleic Acid
  misc_feature (18)..(25): n stands for any nucleotide and can be optionally absent
ccugcaagcugaugaggnnnnnnnnccgaaaugcauuc

SEQ ID NO: 5968 - RNA, 38 nt, Artificial Sequence
  Description of Artificial Sequence:  Enzymatic Nucleic Acid
  misc_feature (18)..(25): n stands for any nucleotide and can be optionally absent
gguccugccugaugaggnnnnnnnnccgaaaggaugca

SEQ ID NO: 5969 - RNA, 38 nt, Artificial Sequence
  Description of Artificial Sequence:  Enzymatic Nucleic Acid
  misc_feature (18)..(25): n stands for any nucleotide and can be optionally absent
ggcagacacugaugaggnnnnnnnnccgaaagucuccu

SEQ ID NO: 5970 - RNA, 38 nt, Artificial Sequence
  Description of Artificial Sequence:  Enzymatic Nucleic Acid
  misc_feature (18)..(25): n stands for any nucleotide and can be optionally absent
gcaaggcacugaugaggnnnnnnnnccgaaacauaguc

SEQ ID NO: 5971 - RNA, 38 nt, Artificial Sequence
  Description of Artificial Sequence:  Enzymatic Nucleic Acid
  misc_feature (18)..(25): n stands for any nucleotide and can be optionally absent
ucuugagccugaugaggnnnnnnnnccgaaaggcagac

SEQ ID NO: 5972 - RNA, 38 nt, Artificial Sequence
  Description of Artificial Sequence:  Enzymatic Nucleic Acid
  misc_feature (18)..(25): n stands for any nucleotide and can be optionally absent
ccugucuucugaugaggnnnnnnnnccgaaagcaaggc

SEQ ID NO: 5973 - RNA, 38 nt, Artificial Sequence
  Description of Artificial Sequence:  Enzymatic Nucleic Acid
  misc_feature (18)..(25): n stands for any nucleotide and can be optionally absent
gaccacgccugaugaggnnnnnnnnccgaaaugucuuu

SEQ ID NO: 5974 - RNA, 38 nt, Artificial Sequence
  Description of Artificial Sequence:  Enzymatic Nucleic Acid
  misc_feature (18)..(25): n stands for any nucleotide and can be optionally absent
agcugccucugaugaggnnnnnnnnccgaaaccacgca

SEQ ID NO: 5975 - RNA, 38 nt, Artificial Sequence
  Description of Artificial Sequence:  Enzymatic Nucleic Acid
  misc_feature (18)..(25): n stands for any nucleotide and can be optionally absent
aggacugucugaugaggnnnnnnnnccgaaagcugccu

SEQ ID NO: 5976 - RNA, 38 nt, Artificial Sequence
  Description of Artificial Sequence:  Enzymatic Nucleic Acid
  misc_feature (18)..(25): n stands for any nucleotide and can be optionally absent
cgcucuagcugaugaggnnnnnnnnccgaaacugugag

SEQ ID NO: 5977 - RNA, 38 nt, Artificial Sequence
  Description of Artificial Sequence:  Enzymatic Nucleic Acid
  misc_feature (18)..(25): n stands for any nucleotide and can be optionally absent
acacgcuccugaugaggnnnnnnnnccgaaaggacugu

SEQ ID NO: 5978 - RNA, 38 nt, Artificial Sequence
  Description of Artificial Sequence:  Enzymatic Nucleic Acid
  misc_feature (18)..(25): n stands for any nucleotide and can be optionally absent
uuuccugucugaugaggnnnnnnnnccgaaaucguggg

SEQ ID NO: 5979 - RNA, 38 nt, Artificial Sequence
  Description of Artificial Sequence:  Enzymatic Nucleic Acid
  misc_feature (18)..(25): n stands for any nucleotide and can be optionally absent
ugucgucucugaugaggnnnnnnnnccgaaauucucca

SEQ ID NO: 5980 - RNA, 38 nt, Artificial Sequence
  Description of Artificial Sequence:  Enzymatic Nucleic Acid
  misc_feature (18)..(25): n stands for any nucleotide and can be optionally absent
uuccccaacugaugaggnnnnnnnnccgaaacuugucg

SEQ ID NO: 5981 - RNA, 38 nt, Artificial Sequence
  Description of Artificial Sequence:  Enzymatic Nucleic Acid
  misc_feature (18)..(25): n stands for any nucleotide and can be optionally absent
cuuucccccugaugaggnnnnnnnnccgaaauacuugu

SEQ ID NO: 5982 - RNA, 38 nt, Artificial Sequence
  Description of Artificial Sequence:  Enzymatic Nucleic Acid
  misc_feature (18)..(25): n stands for any nucleotide and can be optionally absent
gagacuuccugaugaggnnnnnnnnccgaaaugcuuuc

SEQ ID NO: 5983 - RNA, 38 nt, Artificial Sequence
  Description of Artificial Sequence:  Enzymatic Nucleic Acid
  misc_feature (18)..(25): n stands for any nucleotide and can be optionally absent
gugcaugacugaugaggnnnnnnnnccgaaacuucgau

SEQ ID NO: 5984 - RNA, 38 nt, Artificial Sequence
  Description of Artificial Sequence:  Enzymatic Nucleic Acid
  misc_feature (18)..(25): n stands for any nucleotide and can be optionally absent
ccgugcaucugaugaggnnnnnnnnccgaaagacuucg

SEQ ID NO: 5985 - RNA, 38 nt, Artificial Sequence
  Description of Artificial Sequence:  Enzymatic Nucleic Acid
  misc_feature (18)..(25): n stands for any nucleotide and can be optionally absent
gauucccacugaugaggnnnnnnnnccgaaaugccgug

SEQ ID NO: 5986 - RNA, 38 nt, Artificial Sequence
  Description of Artificial Sequence:  Enzymatic Nucleic Acid
  misc_feature (18)..(25): n stands for any nucleotide and can be optionally absent
uggaggggcugaugaggnnnnnnnnccgaaauucccag

SEQ ID NO: 5987 - RNA, 38 nt, Artificial Sequence
  Description of Artificial Sequence:  Enzymatic Nucleic Acid
  misc_feature (18)..(25): n stands for any nucleotide and can be optionally absent
gaucugugcugaugaggnnnnnnnnccgaaagggggau

SEQ ID NO: 5988 - RNA, 38 nt, Artificial Sequence
  Description of Artificial Sequence:  Enzymatic Nucleic Acid
  misc_feature (18)..(25): n stands for any nucleotide and can be optionally absent
aaccacaucugaugaggnnnnnnnnccgaaaucugugg

SEQ ID NO: 5989 - RNA, 38 nt, Artificial Sequence
  Description of Artificial Sequence:  Enzymatic Nucleic Acid
  misc_feature (18)..(25): n stands for any nucleotide and can be optionally absent
uaucuuuacugaugaggnnnnnnnnccgaaaccacaug

SEQ ID NO: 5990 - RNA, 38 nt, Artificial Sequence
  Description of Artificial Sequence:  Enzymatic Nucleic Acid
  misc_feature (18)..(25): n stands for any nucleotide and can be optionally absent
uuaucuuucugaugaggnnnnnnnnccgaaaaccacau

SEQ ID NO: 5991 - RNA, 38 nt, Artificial Sequence
  Description of Artificial Sequence:  Enzymatic Nucleic Acid
  misc_feature (18)..(25): n stands for any nucleotide and can be optionally absent
auuaucuucugaugaggnnnnnnnnccgaaaaaccaca

SEQ ID NO: 5992 - RNA, 38 nt, Artificial Sequence
  Description of Artificial Sequence:  Enzymatic Nucleic Acid
  misc_feature (18)..(25): n stands for any nucleotide and can be optionally absent
ggucucaucugaugaggnnnnnnnnccgaaaucuuuaa

SEQ ID NO: 5993 - RNA, 38 nt, Artificial Sequence
  Description of Artificial Sequence:  Enzymatic Nucleic Acid
  misc_feature (18)..(25): n stands for any nucleotide and can be optionally absent
ucuucuaccugaugaggnnnnnnnnccgaaagggucuc

SEQ ID NO: 5994 - RNA, 38 nt, Artificial Sequence
  Description of Artificial Sequence:  Enzymatic Nucleic Acid
  misc_feature (18)..(25): n stands for any nucleotide and can be optionally absent
gagucuuccugaugaggnnnnnnnnccgaaacaagggu

SEQ ID NO: 5995 - RNA, 38 nt, Artificial Sequence
  Description of Artificial Sequence:  Enzymatic Nucleic Acid
  misc_feature (18)..(25): n stands for any nucleotide and can be optionally absent
caaugccucugaugaggnnnnnnnnccgaaagucuucu

SEQ ID NO: 5996 - RNA, 38 nt, Artificial Sequence
  Description of Artificial Sequence:  Enzymatic Nucleic Acid
  misc_feature (18)..(25): n stands for any nucleotide and can be optionally absent
uucaauaccugaugaggnnnnnnnnccgaaaugccuga

SEQ ID NO: 5997 - RNA, 38 nt, Artificial Sequence
  Description of Artificial Sequence:  Enzymatic Nucleic Acid
  misc_feature (18)..(25): n stands for any nucleotide and can be optionally absent
uccuucaacugaugaggnnnnnnnnccgaaacaaugcc

SEQ ID NO: 5998 - RNA, 38 nt, Artificial Sequence
  Description of Artificial Sequence:  Enzymatic Nucleic Acid
  misc_feature (18)..(25): n stands for any nucleotide and can be optionally absent
cauccuuccugaugaggnnnnnnnnccgaaauacaaug

SEQ ID NO: 5999 - RNA, 38 nt, Artificial Sequence
  Description of Artificial Sequence:  Enzymatic Nucleic Acid
  misc_feature (18)..(25): n stands for any nucleotide and can be optionally absent
cggauagucugaugaggnnnnnnnnccgaaagguuccg

SEQ ID NO: 6000 - RNA, 38 nt, Artificial Sequence
  Description of Artificial Sequence:  Enzymatic Nucleic Acid
  misc_feature (18)..(25): n stands for any nucleotide and can be optionally absent
ucugcggacugaugaggnnnnnnnnccgaaagugaggu

SEQ ID NO: 6001 - RNA, 38 nt, Artificial Sequence
  Description of Artificial Sequence:  Enzymatic Nucleic Acid
  misc_feature (18)..(25): n stands for any nucleotide and can be optionally absent
acucugcgcugaugaggnnnnnnnnccgaaauagugag

SEQ ID NO: 6002 - RNA, 38 nt, Artificial Sequence
  Description of Artificial Sequence:  Enzymatic Nucleic Acid
  misc_feature (18)..(25): n stands for any nucleotide and can be optionally absent
cagguguacugaugaggnnnnnnnnccgaaaggccuuc

SEQ ID NO: 6003 - RNA, 38 nt, Artificial Sequence
  Description of Artificial Sequence:  Enzymatic Nucleic Acid
  misc_feature (18)..(25): n stands for any nucleotide and can be optionally absent
ggcaggugcugaugaggnnnnnnnnccgaaagaggccu

SEQ ID NO: 6004 - RNA, 38 nt, Artificial Sequence
  Description of Artificial Sequence:  Enzymatic Nucleic Acid
  misc_feature (18)..(25): n stands for any nucleotide and can be optionally absent
cagccaagcugaugaggnnnnnnnnccgaaacacugca

SEQ ID NO: 6005 - RNA, 38 nt, Artificial Sequence
  Description of Artificial Sequence:  Enzymatic Nucleic Acid
  misc_feature (18)..(25): n stands for any nucleotide and can be optionally absent
acagccaacugaugaggnnnnnnnnccgaaaacacugc

SEQ ID NO: 6006 - RNA, 38 nt, Artificial Sequence
  Description of Artificial Sequence:  Enzymatic Nucleic Acid
  misc_feature (18)..(25): n stands for any nucleotide and can be optionally absent
gcacagcccugaugaggnnnnnnnnccgaaagaacacu

SEQ ID NO: 6007 - RNA, 38 nt, Artificial Sequence
  Description of Artificial Sequence:  Enzymatic Nucleic Acid
  misc_feature (18)..(25): n stands for any nucleotide and can be optionally absent
uuaugaaacugaugaggnnnnnnnnccgaaaugccucc

SEQ ID NO: 6008 - RNA, 38 nt, Artificial Sequence
  Description of Artificial Sequence:  Enzymatic Nucleic Acid
  misc_feature (18)..(25): n stands for any nucleotide and can be optionally absent
auuaugaacugaugaggnnnnnnnnccgaaaaugccuc

SEQ ID NO: 6009 - RNA, 38 nt, Artificial Sequence
  Description of Artificial Sequence:  Enzymatic Nucleic Acid
  misc_feature (18)..(25): n stands for any nucleotide and can be optionally absent
uauuaugacugaugaggnnnnnnnnccgaaaaaugccu

SEQ ID NO: 6010 - RNA, 38 nt, Artificial Sequence
  Description of Artificial Sequence:  Enzymatic Nucleic Acid
  misc_feature (18)..(25): n stands for any nucleotide and can be optionally absent
cuauuaugcugaugaggnnnnnnnnccgaaaaaaugcc

SEQ ID NO: 6011 - RNA, 38 nt, Artificial Sequence
  Description of Artificial Sequence:  Enzymatic Nucleic Acid
  misc_feature (18)..(25): n stands for any nucleotide and can be optionally absent
ucuauuaucugaugaggnnnnnnnnccgaaaaaaaugc

SEQ ID NO: 6012 - RNA, 38 nt, Artificial Sequence
  Description of Artificial Sequence:  Enzymatic Nucleic Acid
  misc_feature (18)..(25): n stands for any nucleotide and can be optionally absent
ccuucuaucugaugaggnnnnnnnnccgaaaugaaaaa

SEQ ID NO: 6013 - RNA, 38 nt, Artificial Sequence
  Description of Artificial Sequence:  Enzymatic Nucleic Acid
  misc_feature (18)..(25): n stands for any nucleotide and can be optionally absent
gcaccuuccugaugaggnnnnnnnnccgaaauuaugaa

SEQ ID NO: 6014 - RNA, 38 nt, Artificial Sequence
  Description of Artificial Sequence:  Enzymatic Nucleic Acid
  misc_feature (18)..(25): n stands for any nucleotide and can be optionally absent
ugauuucccugaugaggnnnnnnnnccgaaaguucguc

SEQ ID NO: 6015 - RNA, 38 nt, Artificial Sequence
  Description of Artificial Sequence:  Enzymatic Nucleic Acid
  misc_feature (18)..(25): n stands for any nucleotide and can be optionally absent
agaauaaucugaugaggnnnnnnnnccgaaauuuccaa

SEQ ID NO: 6016 - RNA, 38 nt, Artificial Sequence
  Description of Artificial Sequence:  Enzymatic Nucleic Acid
  misc_feature (18)..(25): n stands for any nucleotide and can be optionally absent
acuagaaucugaugaggnnnnnnnnccgaaaugauuuc

SEQ ID NO: 6017 - RNA, 38 nt, Artificial Sequence
  Description of Artificial Sequence:  Enzymatic Nucleic Acid
  misc_feature (18)..(25): n stands for any nucleotide and can be optionally absent
uacuagaacugaugaggnnnnnnnnccgaaaaugauuu

SEQ ID NO: 6018 - RNA, 38 nt, Artificial Sequence
  Description of Artificial Sequence:  Enzymatic Nucleic Acid
  misc_feature (18)..(25): n stands for any nucleotide and can be optionally absent
ccuacuagcugaugaggnnnnnnnnccgaaauaaugau

SEQ ID NO: 6019 - RNA, 38 nt, Artificial Sequence
  Description of Artificial Sequence:  Enzymatic Nucleic Acid
  misc_feature (18)..(25): n stands for any nucleotide and can be optionally absent
gccuacuacugaugaggnnnnnnnnccgaaaauaauga

SEQ ID NO: 6020 - RNA, 38 nt, Artificial Sequence
  Description of Artificial Sequence:  Enzymatic Nucleic Acid
  misc_feature (18)..(25): n stands for any nucleotide and can be optionally absent
gugccuaccugaugaggnnnnnnnnccgaaagaauaau

SEQ ID NO: 6021 - RNA, 38 nt, Artificial Sequence
  Description of Artificial Sequence:  Enzymatic Nucleic Acid
  misc_feature (18)..(25): n stands for any nucleotide and can be optionally absent
gucgugcccugaugaggnnnnnnnnccgaaacuagaau

SEQ ID NO: 6022 - RNA, 38 nt, Artificial Sequence
  Description of Artificial Sequence:  Enzymatic Nucleic Acid
  misc_feature (18)..(25): n stands for any nucleotide and can be optionally absent
aacauggccugaugaggnnnnnnnnccgaaaucaccgu

SEQ ID NO: 6023 - RNA, 38 nt, Artificial Sequence
  Description of Artificial Sequence:  Enzymatic Nucleic Acid
  misc_feature (18)..(25): n stands for any nucleotide and can be optionally absent
gccagaagcugaugaggnnnnnnnnccgaaacauggca

SEQ ID NO: 6024 - RNA, 38 nt, Artificial Sequence
  Description of Artificial Sequence:  Enzymatic Nucleic Acid
  misc_feature (18)..(25): n stands for any nucleotide and can be optionally absent
agccagaacugaugaggnnnnnnnnccgaaaacauggc

SEQ ID NO: 6025 - RNA, 38 nt, Artificial Sequence
  Description of Artificial Sequence:  Enzymatic Nucleic Acid
  misc_feature (18)..(25): n stands for any nucleotide and can be optionally absent
guagccagcugaugaggnnnnnnnnccgaaagaacaug

SEQ ID NO: 6026 - RNA, 38 nt, Artificial Sequence
  Description of Artificial Sequence:  Enzymatic Nucleic Acid
  misc_feature (18)..(25): n stands for any nucleotide and can be optionally absent
aguagccacugaugaggnnnnnnnnccgaaaagaacau

SEQ ID NO: 6027 - RNA, 38 nt, Artificial Sequence
  Description of Artificial Sequence:  Enzymatic Nucleic Acid
  misc_feature (18)..(25): n stands for any nucleotide and can be optionally absent
acaagaagcugaugaggnnnnnnnnccgaaagccagaa

SEQ ID NO: 6028 - RNA, 38 nt, Artificial Sequence
  Description of Artificial Sequence:  Enzymatic Nucleic Acid
  misc_feature (18)..(25): n stands for any nucleotide and can be optionally absent
augacaagcugaugaggnnnnnnnnccgaaaguagcca

SEQ ID NO: 6029 - RNA, 38 nt, Artificial Sequence
  Description of Artificial Sequence:  Enzymatic Nucleic Acid
  misc_feature (18)..(25): n stands for any nucleotide and can be optionally absent
gaugacaacugaugaggnnnnnnnnccgaaaaguagcc

SEQ ID NO: 6030 - RNA, 38 nt, Artificial Sequence
  Description of Artificial Sequence:  Enzymatic Nucleic Acid
  misc_feature (18)..(25): n stands for any nucleotide and can be optionally absent
augaugaccugaugaggnnnnnnnnccgaaagaaguag

SEQ ID NO: 6031 - RNA, 38 nt, Artificial Sequence
  Description of Artificial Sequence:  Enzymatic Nucleic Acid
  misc_feature (18)..(25): n stands for any nucleotide and can be optionally absent
aggaugaucugaugaggnnnnnnnnccgaaacaagaag

SEQ ID NO: 6032 - RNA, 38 nt, Artificial Sequence
  Description of Artificial Sequence:  Enzymatic Nucleic Acid
  misc_feature (18)..(25): n stands for any nucleotide and can be optionally absent
ccuaggaucugaugaggnnnnnnnnccgaaaugacaag

SEQ ID NO: 6033 - RNA, 38 nt, Artificial Sequence
  Description of Artificial Sequence:  Enzymatic Nucleic Acid
  misc_feature (18)..(25): n stands for any nucleotide and can be optionally absent
gucccuagcugaugaggnnnnnnnnccgaaaugaugac

SEQ ID NO: 6034 - RNA, 38 nt, Artificial Sequence
  Description of Artificial Sequence:  Enzymatic Nucleic Acid
  misc_feature (18)..(25): n stands for any nucleotide and can be optionally absent
acgguccccugaugaggnnnnnnnnccgaaaggaugau

SEQ ID NO: 6035 - RNA, 38 nt, Artificial Sequence
  Description of Artificial Sequence:  Enzymatic Nucleic Acid
  misc_feature (18)..(25): n stands for any nucleotide and can be optionally absent
gcccgcuucugaugaggnnnnnnnnccgaaacgguccc

SEQ ID NO: 6036 - RNA, 38 nt, Artificial Sequence
  Description of Artificial Sequence:  Enzymatic Nucleic Acid
  misc_feature (18)..(25): n stands for any nucleotide and can be optionally absent
ggcccgcucugaugaggnnnnnnnnccgaaaacggucc

SEQ ID NO: 6037 - RNA, 38 nt, Artificial Sequence
  Description of Artificial Sequence:  Enzymatic Nucleic Acid
  misc_feature (18)..(25): n stands for any nucleotide and can be optionally absent
uggacaagcugaugaggnnnnnnnnccgaaagccuguc

SEQ ID NO: 6038 - RNA, 38 nt, Artificial Sequence
  Description of Artificial Sequence:  Enzymatic Nucleic Acid
  misc_feature (18)..(25): n stands for any nucleotide and can be optionally absent
cgauggaccugaugaggnnnnnnnnccgaaaguagccu

SEQ ID NO: 6039 - RNA, 38 nt, Artificial Sequence
  Description of Artificial Sequence:  Enzymatic Nucleic Acid
  misc_feature (18)..(25): n stands for any nucleotide and can be optionally absent
ugacgaugcugaugaggnnnnnnnnccgaaacaaguag

SEQ ID NO: 6040 - RNA, 38 nt, Artificial Sequence
  Description of Artificial Sequence:  Enzymatic Nucleic Acid
  misc_feature (18)..(25): n stands for any nucleotide and can be optionally absent
uccaugaccugaugaggnnnnnnnnccgaaauggacaa

SEQ ID NO: 6041 - RNA, 38 nt, Artificial Sequence
  Description of Artificial Sequence:  Enzymatic Nucleic Acid
  misc_feature (18)..(25): n stands for any nucleotide and can be optionally absent
ggauccaucugaugaggnnnnnnnnccgaaacgaugga

SEQ ID NO: 6042 - RNA, 38 nt, Artificial Sequence
  Description of Artificial Sequence:  Enzymatic Nucleic Acid
  misc_feature (18)..(25): n stands for any nucleotide and can be optionally absent
uucaucugcugaugaggnnnnnnnnccgaaauccauga

SEQ ID NO: 6043 - RNA, 38 nt, Artificial Sequence
  Description of Artificial Sequence:  Enzymatic Nucleic Acid
  misc_feature (18)..(25): n stands for any nucleotide and can be optionally absent
uccaauggcugaugaggnnnnnnnnccgaaaguucauc

SEQ ID NO: 6044 - RNA, 38 nt, Artificial Sequence
  Description of Artificial Sequence:  Enzymatic Nucleic Acid
  misc_feature (18)..(25): n stands for any nucleotide and can be optionally absent
guucaucccugaugaggnnnnnnnnccgaaaugggagu

SEQ ID NO: 6045 - RNA, 38 nt, Artificial Sequence
  Description of Artificial Sequence:  Enzymatic Nucleic Acid
  misc_feature (18)..(25): n stands for any nucleotide and can be optionally absent
ucguucaccugaugaggnnnnnnnnccgaaauguucau

SEQ ID NO: 6046 - RNA, 38 nt, Artificial Sequence
  Description of Artificial Sequence:  Enzymatic Nucleic Acid
  misc_feature (18)..(25): n stands for any nucleotide and can be optionally absent
ggcaucaucugaugaggnnnnnnnnccgaaaggcaguc

SEQ ID NO: 6047 - RNA, 38 nt, Artificial Sequence
  Description of Artificial Sequence:  Enzymatic Nucleic Acid
  misc_feature (18)..(25): n stands for any nucleotide and can be optionally absent
uggcaucacugaugaggnnnnnnnnccgaaaaggcagu

SEQ ID NO: 6048 - RNA, 38 nt, Artificial Sequence
  Description of Artificial Sequence:  Enzymatic Nucleic Acid
  misc_feature (18)..(25): n stands for any nucleotide and can be optionally absent
cucuggggcugaugaggnnnnnnnnccgaaauucccau

SEQ ID NO: 6049 - RNA, 38 nt, Artificial Sequence
  Description of Artificial Sequence:  Enzymatic Nucleic Acid
  misc_feature (18)..(25): n stands for any nucleotide and can be optionally absent
ucucugggcugaugaggnnnnnnnnccgaaaauuccca

SEQ ID NO: 6050 - RNA, 38 nt, Artificial Sequence
  Description of Artificial Sequence:  Enzymatic Nucleic Acid
  misc_feature (18)..(25): n stands for any nucleotide and can be optionally absent
ggcuuacccugaugaggnnnnnnnnccgaaagguucag

SEQ ID NO: 6051 - RNA, 38 nt, Artificial Sequence
  Description of Artificial Sequence:  Enzymatic Nucleic Acid
  misc_feature (18)..(25): n stands for any nucleotide and can be optionally absent
aagaggcucugaugaggnnnnnnnnccgaaaccuaggu

SEQ ID NO: 6052 - RNA, 38 nt, Artificial Sequence
  Description of Artificial Sequence:  Enzymatic Nucleic Acid
  misc_feature (18)..(25): n stands for any nucleotide and can be optionally absent
acggccaacugaugaggnnnnnnnnccgaaaggcuuac

SEQ ID NO: 6053 - RNA, 38 nt, Artificial Sequence
  Description of Artificial Sequence:  Enzymatic Nucleic Acid
  misc_feature (18)..(25): n stands for any nucleotide and can be optionally absent
ccacggcccugaugaggnnnnnnnnccgaaagaggcuu

SEQ ID NO: 6054 - RNA, 38 nt, Artificial Sequence
  Description of Artificial Sequence:  Enzymatic Nucleic Acid
  misc_feature (18)..(25): n stands for any nucleotide and can be optionally absent
cuuggccacugaugaggnnnnnnnnccgaaaggcacca

SEQ ID NO: 6055 - RNA, 38 nt, Artificial Sequence
  Description of Artificial Sequence:  Enzymatic Nucleic Acid
  misc_feature (18)..(25): n stands for any nucleotide and can be optionally absent
ucuuggcccugaugaggnnnnnnnnccgaaaaggcacc

SEQ ID NO: 6056 - RNA, 38 nt, Artificial Sequence
  Description of Artificial Sequence:  Enzymatic Nucleic Acid
  misc_feature (18)..(25): n stands for any nucleotide and can be optionally absent
ucugcuuccugaugaggnnnnnnnnccgaaaucucuug

SEQ ID NO: 6057 - RNA, 38 nt, Artificial Sequence
  Description of Artificial Sequence:  Enzymatic Nucleic Acid
  misc_feature (18)..(25): n stands for any nucleotide and can be optionally absent
caauuccacugaugaggnnnnnnnnccgaaaggcaucu

SEQ ID NO: 6058 - RNA, 38 nt, Artificial Sequence
  Description of Artificial Sequence:  Enzymatic Nucleic Acid
  misc_feature (18)..(25): n stands for any nucleotide and can be optionally absent
ucaauucccugaugaggnnnnnnnnccgaaaaggcauc

SEQ ID NO: 6059 - RNA, 38 nt, Artificial Sequence
  Description of Artificial Sequence:  Enzymatic Nucleic Acid
  misc_feature (18)..(25): n stands for any nucleotide and can be optionally absent
gucuuguccugaugaggnnnnnnnnccgaaauuccaaa

SEQ ID NO: 6060 - RNA, 38 nt, Artificial Sequence
  Description of Artificial Sequence:  Enzymatic Nucleic Acid
  misc_feature (18)..(25): n stands for any nucleotide and can be optionally absent
uguccugccugaugaggnnnnnnnnccgaaaguugcug

SEQ ID NO: 6061 - RNA, 38 nt, Artificial Sequence
  Description of Artificial Sequence:  Enzymatic Nucleic Acid
  misc_feature (18)..(25): n stands for any nucleotide and can be optionally absent
uugacugccugaugaggnnnnnnnnccgaaacuguccu

SEQ ID NO: 6062 - RNA, 38 nt, Artificial Sequence
  Description of Artificial Sequence:  Enzymatic Nucleic Acid
  misc_feature (18)..(25): n stands for any nucleotide and can be optionally absent
aacauuuucugaugaggnnnnnnnnccgaaacugcuac

SEQ ID NO: 6063 - RNA, 38 nt, Artificial Sequence
  Description of Artificial Sequence:  Enzymatic Nucleic Acid
  misc_feature (18)..(25): n stands for any nucleotide and can be optionally absent
cuucuuuccugaugaggnnnnnnnnccgaaacauuuug

SEQ ID NO: 6064 - RNA, 38 nt, Artificial Sequence
  Description of Artificial Sequence:  Enzymatic Nucleic Acid
  misc_feature (18)..(25): n stands for any nucleotide and can be optionally absent
gagagcuccugaugaggnnnnnnnnccgaaaugcucac

SEQ ID NO: 6065 - RNA, 38 nt, Artificial Sequence
  Description of Artificial Sequence:  Enzymatic Nucleic Acid
  misc_feature (18)..(25): n stands for any nucleotide and can be optionally absent
agacaugacugaugaggnnnnnnnnccgaaagcucgau

SEQ ID NO: 6066 - RNA, 38 nt, Artificial Sequence
  Description of Artificial Sequence:  Enzymatic Nucleic Acid
  misc_feature (18)..(25): n stands for any nucleotide and can be optionally absent
ucagacaucugaugaggnnnnnnnnccgaaagagcucg

SEQ ID NO: 6067 - RNA, 38 nt, Artificial Sequence
  Description of Artificial Sequence:  Enzymatic Nucleic Acid
  misc_feature (18)..(25): n stands for any nucleotide and can be optionally absent
ugaguucacugaugaggnnnnnnnnccgaaacaugaga

SEQ ID NO: 6068 - RNA, 38 nt, Artificial Sequence
  Description of Artificial Sequence:  Enzymatic Nucleic Acid
  misc_feature (18)..(25): n stands for any nucleotide and can be optionally absent
aggaucuucugaugaggnnnnnnnnccgaaaguucaga

SEQ ID NO: 6069 - RNA, 38 nt, Artificial Sequence
  Description of Artificial Sequence:  Enzymatic Nucleic Acid
  misc_feature (18)..(25): n stands for any nucleotide and can be optionally absent
ugaaugagcugaugaggnnnnnnnnccgaaaucuugag

SEQ ID NO: 6070 - RNA, 38 nt, Artificial Sequence
  Description of Artificial Sequence:  Enzymatic Nucleic Acid
  misc_feature (18)..(25): n stands for any nucleotide and can be optionally absent
auaugaaucugaugaggnnnnnnnnccgaaaggaucuu

SEQ ID NO: 6071 - RNA, 38 nt, Artificial Sequence
  Description of Artificial Sequence:  Enzymatic Nucleic Acid
  misc_feature (18)..(25): n stands for any nucleotide and can be optionally absent
ccaauaugcugaugaggnnnnnnnnccgaaaugaggau

SEQ ID NO: 6072 - RNA, 38 nt, Artificial Sequence
  Description of Artificial Sequence:  Enzymatic Nucleic Acid
  misc_feature (18)..(25): n stands for any nucleotide and can be optionally absent
accaauaucugaugaggnnnnnnnnccgaaaaugagga

SEQ ID NO: 6073 - RNA, 38 nt, Artificial Sequence
  Description of Artificial Sequence:  Enzymatic Nucleic Acid
  misc_feature (18)..(25): n stands for any nucleotide and can be optionally absent
gugaccaacugaugaggnnnnnnnnccgaaaugaauga

SEQ ID NO: 6074 - RNA, 38 nt, Artificial Sequence
  Description of Artificial Sequence:  Enzymatic Nucleic Acid
  misc_feature (18)..(25): n stands for any nucleotide and can be optionally absent
uggugacccugaugaggnnnnnnnnccgaaauaugaau

SEQ ID NO: 6075 - RNA, 38 nt, Artificial Sequence
  Description of Artificial Sequence:  Enzymatic Nucleic Acid
  misc_feature (18)..(25): n stands for any nucleotide and can be optionally absent
gagauggucugaugaggnnnnnnnnccgaaaccaauau

SEQ ID NO: 6076 - RNA, 38 nt, Artificial Sequence
  Description of Artificial Sequence:  Enzymatic Nucleic Acid
  misc_feature (18)..(25): n stands for any nucleotide and can be optionally absent
cacauugacugaugaggnnnnnnnnccgaaauggugac

SEQ ID NO: 6077 - RNA, 38 nt, Artificial Sequence
  Description of Artificial Sequence:  Enzymatic Nucleic Acid
  misc_feature (18)..(25): n stands for any nucleotide and can be optionally absent
accacauucugaugaggnnnnnnnnccgaaagauggug

SEQ ID NO: 6078 - RNA, 38 nt, Artificial Sequence
  Description of Artificial Sequence:  Enzymatic Nucleic Acid
  misc_feature (18)..(25): n stands for any nucleotide and can be optionally absent
agaagguucugaugaggnnnnnnnnccgaaaccacauu

SEQ ID NO: 6079 - RNA, 38 nt, Artificial Sequence
  Description of Artificial Sequence:  Enzymatic Nucleic Acid
  misc_feature (18)..(25): n stands for any nucleotide and can be optionally absent
gcaccuagcugaugaggnnnnnnnnccgaaagguugac

SEQ ID NO: 6080 - RNA, 38 nt, Artificial Sequence
  Description of Artificial Sequence:  Enzymatic Nucleic Acid
  misc_feature (18)..(25): n stands for any nucleotide and can be optionally absent
ggcaccuacugaugaggnnnnnnnnccgaaaagguuga

SEQ ID NO: 6081 - RNA, 38 nt, Artificial Sequence
  Description of Artificial Sequence:  Enzymatic Nucleic Acid
  misc_feature (18)..(25): n stands for any nucleotide and can be optionally absent
caggcacccugaugaggnnnnnnnnccgaaagaagguu

SEQ ID NO: 6082 - RNA, 38 nt, Artificial Sequence
  Description of Artificial Sequence:  Enzymatic Nucleic Acid
  misc_feature (18)..(25): n stands for any nucleotide and can be optionally absent
uggcuuggcugaugaggnnnnnnnnccgaaacaggcac

SEQ ID NO: 6083 - RNA, 38 nt, Artificial Sequence
  Description of Artificial Sequence:  Enzymatic Nucleic Acid
  misc_feature (18)..(25): n stands for any nucleotide and can be optionally absent
aucaccaucugaugaggnnnnnnnnccgaaaguggccc

SEQ ID NO: 6084 - RNA, 38 nt, Artificial Sequence
  Description of Artificial Sequence:  Enzymatic Nucleic Acid
  misc_feature (18)..(25): n stands for any nucleotide and can be optionally absent
aauuccaccugaugaggnnnnnnnnccgaaaucaccau

SEQ ID NO: 6085 - RNA, 38 nt, Artificial Sequence
  Description of Artificial Sequence:  Enzymatic Nucleic Acid
  misc_feature (18)..(25): n stands for any nucleotide and can be optionally absent
auuugcagcugaugaggnnnnnnnnccgaaauuccaca

SEQ ID NO: 6086 - RNA, 38 nt, Artificial Sequence
  Description of Artificial Sequence:  Enzymatic Nucleic Acid
  misc_feature (18)..(25): n stands for any nucleotide and can be optionally absent
aauuugcacugaugaggnnnnnnnnccgaaaauuccac

SEQ ID NO: 6087 - RNA, 38 nt, Artificial Sequence
  Description of Artificial Sequence:  Enzymatic Nucleic Acid
  misc_feature (18)..(25): n stands for any nucleotide and can be optionally absent
gguuuccacugaugaggnnnnnnnnccgaaauuugcag

SEQ ID NO: 6088 - RNA, 38 nt, Artificial Sequence
  Description of Artificial Sequence:  Enzymatic Nucleic Acid
  misc_feature (18)..(25): n stands for any nucleotide and can be optionally absent
agguuucccugaugaggnnnnnnnnccgaaaauuugca

SEQ ID NO: 6089 - RNA, 38 nt, Artificial Sequence
  Description of Artificial Sequence:  Enzymatic Nucleic Acid
  misc_feature (18)..(25): n stands for any nucleotide and can be optionally absent
gguaagugcugaugaggnnnnnnnnccgaaacagguuu

SEQ ID NO: 6090 - RNA, 38 nt, Artificial Sequence
  Description of Artificial Sequence:  Enzymatic Nucleic Acid
  misc_feature (18)..(25): n stands for any nucleotide and can be optionally absent
ccucaggucugaugaggnnnnnnnnccgaaaguggaca

SEQ ID NO: 6091 - RNA, 38 nt, Artificial Sequence
  Description of Artificial Sequence:  Enzymatic Nucleic Acid
  misc_feature (18)..(25): n stands for any nucleotide and can be optionally absent
uccucaggcugaugaggnnnnnnnnccgaaaaguggac

SEQ ID NO: 6092 - RNA, 38 nt, Artificial Sequence
  Description of Artificial Sequence:  Enzymatic Nucleic Acid
  misc_feature (18)..(25): n stands for any nucleotide and can be optionally absent
aggggacacugaugaggnnnnnnnnccgaaauucauuu

SEQ ID NO: 6093 - RNA, 38 nt, Artificial Sequence
  Description of Artificial Sequence:  Enzymatic Nucleic Acid
  misc_feature (18)..(25): n stands for any nucleotide and can be optionally absent
uaggggaccugaugaggnnnnnnnnccgaaaauucauu

SEQ ID NO: 6094 - RNA, 38 nt, Artificial Sequence
  Description of Artificial Sequence:  Enzymatic Nucleic Acid
  misc_feature (18)..(25): n stands for any nucleotide and can be optionally absent
uuguagggcugaugaggnnnnnnnnccgaaacaaauuc

SEQ ID NO: 6095 - RNA, 38 nt, Artificial Sequence
  Description of Artificial Sequence:  Enzymatic Nucleic Acid
  misc_feature (18)..(25): n stands for any nucleotide and can be optionally absent
uggucuugcugaugaggnnnnnnnnccgaaaggggaca

SEQ ID NO: 6096 - RNA, 38 nt, Artificial Sequence
  Description of Artificial Sequence:  Enzymatic Nucleic Acid
  misc_feature (18)..(25): n stands for any nucleotide and can be optionally absent
cuugacggcugaugaggnnnnnnnnccgaaaucgugcc

SEQ ID NO: 6097 - RNA, 38 nt, Artificial Sequence
  Description of Artificial Sequence:  Enzymatic Nucleic Acid
  misc_feature (18)..(25): n stands for any nucleotide and can be optionally absent
ccuugacgcugaugaggnnnnnnnnccgaaaaucgugc

SEQ ID NO: 6098 - RNA, 38 nt, Artificial Sequence
  Description of Artificial Sequence:  Enzymatic Nucleic Acid
  misc_feature (18)..(25): n stands for any nucleotide and can be optionally absent
uuucccuucugaugaggnnnnnnnnccgaaacggaauc

SEQ ID NO: 6099 - RNA, 38 nt, Artificial Sequence
  Description of Artificial Sequence:  Enzymatic Nucleic Acid
  misc_feature (18)..(25): n stands for any nucleotide and can be optionally absent
cuccaacgcugaugaggnnnnnnnnccgaaagucuuuc

SEQ ID NO: 6100 - RNA, 38 nt, Artificial Sequence
  Description of Artificial Sequence:  Enzymatic Nucleic Acid
  misc_feature (18)..(25): n stands for any nucleotide and can be optionally absent
auugcucccugaugaggnnnnnnnnccgaaacguaguc

SEQ ID NO: 6101 - RNA, 38 nt, Artificial Sequence
  Description of Artificial Sequence:  Enzymatic Nucleic Acid
  misc_feature (18)..(25): n stands for any nucleotide and can be optionally absent
uccacaggcugaugaggnnnnnnnnccgaaauugcucc

SEQ ID NO: 6102 - RNA, 38 nt, Artificial Sequence
  Description of Artificial Sequence:  Enzymatic Nucleic Acid
  misc_feature (18)..(25): n stands for any nucleotide and can be optionally absent
ccguuucacugaugaggnnnnnnnnccgaaauccacag

SEQ ID NO: 6103 - RNA, 38 nt, Artificial Sequence
  Description of Artificial Sequence:  Enzymatic Nucleic Acid
  misc_feature (18)..(25): n stands for any nucleotide and can be optionally absent
ugcugucccugaugaggnnnnnnnnccgaaagcgccgu

SEQ ID NO: 6104 - RNA, 38 nt, Artificial Sequence
  Description of Artificial Sequence:  Enzymatic Nucleic Acid
  misc_feature (18)..(25): n stands for any nucleotide and can be optionally absent
cuacuggucugaugaggnnnnnnnnccgaaaugcuguc

SEQ ID NO: 6105 - RNA, 38 nt, Artificial Sequence
  Description of Artificial Sequence:  Enzymatic Nucleic Acid
  misc_feature (18)..(25): n stands for any nucleotide and can be optionally absent
gcucuggccugaugaggnnnnnnnnccgaaacugguga

SEQ ID NO: 6106 - RNA, 38 nt, Artificial Sequence
  Description of Artificial Sequence:  Enzymatic Nucleic Acid
  misc_feature (18)..(25): n stands for any nucleotide and can be optionally absent
agcuggcucugaugaggnnnnnnnnccgaaagcucugg

SEQ ID NO: 6107 - RNA, 38 nt, Artificial Sequence
  Description of Artificial Sequence:  Enzymatic Nucleic Acid
  misc_feature (18)..(25): n stands for any nucleotide and can be optionally absent
caaauccacugaugaggnnnnnnnnccgaaagcuggcu

SEQ ID NO: 6108 - RNA, 38 nt, Artificial Sequence
  Description of Artificial Sequence:  Enzymatic Nucleic Acid
  misc_feature (18)..(25): n stands for any nucleotide and can be optionally absent
ccuccacacugaugaggnnnnnnnnccgaaauccagag

SEQ ID NO: 6109 - RNA, 38 nt, Artificial Sequence
  Description of Artificial Sequence:  Enzymatic Nucleic Acid
  misc_feature (18)..(25): n stands for any nucleotide and can be optionally absent
uccuccaccugaugaggnnnnnnnnccgaaaauccaga

SEQ ID NO: 6110 - RNA, 38 nt, Artificial Sequence
  Description of Artificial Sequence:  Enzymatic Nucleic Acid
  misc_feature (18)..(25): n stands for any nucleotide and can be optionally absent
cacugaggcugaugaggnnnnnnnnccgaaacuucucc

SEQ ID NO: 6111 - RNA, 38 nt, Artificial Sequence
  Description of Artificial Sequence:  Enzymatic Nucleic Acid
  misc_feature (18)..(25): n stands for any nucleotide and can be optionally absent
acaucacucugaugaggnnnnnnnnccgaaagggacuu

SEQ ID NO: 6112 - RNA, 38 nt, Artificial Sequence
  Description of Artificial Sequence:  Enzymatic Nucleic Acid
  misc_feature (18)..(25): n stands for any nucleotide and can be optionally absent
ucuucuuccugaugaggnnnnnnnnccgaaacaucacu

SEQ ID NO: 6113 - RNA, 38 nt, Artificial Sequence
  Description of Artificial Sequence:  Enzymatic Nucleic Acid
  misc_feature (18)..(25): n stands for any nucleotide and can be optionally absent
aucuucagcugaugaggnnnnnnnnccgaaagcuuccu

SEQ ID NO: 6114 - RNA, 38 nt, Artificial Sequence
  Description of Artificial Sequence:  Enzymatic Nucleic Acid
  misc_feature (18)..(25): n stands for any nucleotide and can be optionally absent
cuuauacacugaugaggnnnnnnnnccgaaaucuucag

SEQ ID NO: 6115 - RNA, 38 nt, Artificial Sequence
  Description of Artificial Sequence:  Enzymatic Nucleic Acid
  misc_feature (18)..(25): n stands for any nucleotide and can be optionally absent
aguccuuacugaugaggnnnnnnnnccgaaacagaucu

SEQ ID NO: 6116 - RNA, 38 nt, Artificial Sequence
  Description of Artificial Sequence:  Enzymatic Nucleic Acid
  misc_feature (18)..(25): n stands for any nucleotide and can be optionally absent
gaaguccucugaugaggnnnnnnnnccgaaauacagau

SEQ ID NO: 6117 - RNA, 38 nt, Artificial Sequence
  Description of Artificial Sequence:  Enzymatic Nucleic Acid
  misc_feature (18)..(25): n stands for any nucleotide and can be optionally absent
aggucaggcugaugaggnnnnnnnnccgaaaguccuua

SEQ ID NO: 6118 - RNA, 38 nt, Artificial Sequence
  Description of Artificial Sequence:  Enzymatic Nucleic Acid
  misc_feature (18)..(25): n stands for any nucleotide and can be optionally absent
aaggucagcugaugaggnnnnnnnnccgaaaaguccuu

SEQ ID NO: 6119 - RNA, 38 nt, Artificial Sequence
  Description of Artificial Sequence:  Enzymatic Nucleic Acid
  misc_feature (18)..(25): n stands for any nucleotide and can be optionally absent
gaugcucccugaugaggnnnnnnnnccgaaaggucagg

SEQ ID NO: 6120 - RNA, 38 nt, Artificial Sequence
  Description of Artificial Sequence:  Enzymatic Nucleic Acid
  misc_feature (18)..(25): n stands for any nucleotide and can be optionally absent
acagaugacugaugaggnnnnnnnnccgaaaugcucca

SEQ ID NO: 6121 - RNA, 38 nt, Artificial Sequence
  Description of Artificial Sequence:  Enzymatic Nucleic Acid
  misc_feature (18)..(25): n stands for any nucleotide and can be optionally absent
uaacagaucugaugaggnnnnnnnnccgaaagaugcuc

SEQ ID NO: 6122 - RNA, 38 nt, Artificial Sequence
  Description of Artificial Sequence:  Enzymatic Nucleic Acid
  misc_feature (18)..(25): n stands for any nucleotide and can be optionally absent
cuguaacacugaugaggnnnnnnnnccgaaaugagaug

SEQ ID NO: 6123 - RNA, 38 nt, Artificial Sequence
  Description of Artificial Sequence:  Enzymatic Nucleic Acid
  misc_feature (18)..(25): n stands for any nucleotide and can be optionally absent
gaagcugucugaugaggnnnnnnnnccgaaacagauga

SEQ ID NO: 6124 - RNA, 38 nt, Artificial Sequence
  Description of Artificial Sequence:  Enzymatic Nucleic Acid
  misc_feature (18)..(25): n stands for any nucleotide and can be optionally absent
ggaagcugcugaugaggnnnnnnnnccgaaaacagaug

SEQ ID NO: 6125 - RNA, 38 nt, Artificial Sequence
  Description of Artificial Sequence:  Enzymatic Nucleic Acid
  misc_feature (18)..(25): n stands for any nucleotide and can be optionally absent
ccacuuggcugaugaggnnnnnnnnccgaaagcuguaa

SEQ ID NO: 6126 - RNA, 38 nt, Artificial Sequence
  Description of Artificial Sequence:  Enzymatic Nucleic Acid
  misc_feature (18)..(25): n stands for any nucleotide and can be optionally absent
gccacuugcugaugaggnnnnnnnnccgaaaagcugua

SEQ ID NO: 6127 - RNA, 38 nt, Artificial Sequence
  Description of Artificial Sequence:  Enzymatic Nucleic Acid
  misc_feature (18)..(25): n stands for any nucleotide and can be optionally absent
caugcccucugaugaggnnnnnnnnccgaaagccacuu

SEQ ID NO: 6128 - RNA, 38 nt, Artificial Sequence
  Description of Artificial Sequence:  Enzymatic Nucleic Acid
  misc_feature (18)..(25): n stands for any nucleotide and can be optionally absent
augccaagcugaugaggnnnnnnnnccgaaacuccaug

SEQ ID NO: 6129 - RNA, 38 nt, Artificial Sequence
  Description of Artificial Sequence:  Enzymatic Nucleic Acid
  misc_feature (18)..(25): n stands for any nucleotide and can be optionally absent
gaugccaacugaugaggnnnnnnnnccgaaaacuccau

SEQ ID NO: 6130 - RNA, 38 nt, Artificial Sequence
  Description of Artificial Sequence:  Enzymatic Nucleic Acid
  misc_feature (18)..(25): n stands for any nucleotide and can be optionally absent
gcgaugcccugaugaggnnnnnnnnccgaaagaacucc

SEQ ID NO: 6131 - RNA, 38 nt, Artificial Sequence
  Description of Artificial Sequence:  Enzymatic Nucleic Acid
  misc_feature (18)..(25): n stands for any nucleotide and can be optionally absent
acuuucgccugaugaggnnnnnnnnccgaaaugccaag

SEQ ID NO: 6132 - RNA, 38 nt, Artificial Sequence
  Description of Artificial Sequence:  Enzymatic Nucleic Acid
  misc_feature (18)..(25): n stands for any nucleotide and can be optionally absent
ccuguggacugaugaggnnnnnnnnccgaaacacuuuc

SEQ ID NO: 6133 - RNA, 38 nt, Artificial Sequence
  Description of Artificial Sequence:  Enzymatic Nucleic Acid
  misc_feature (18)..(25): n stands for any nucleotide and can be optionally absent
ucccugugcugaugaggnnnnnnnnccgaaauacacuu

SEQ ID NO: 6134 - RNA, 38 nt, Artificial Sequence
  Description of Artificial Sequence:  Enzymatic Nucleic Acid
  misc_feature (18)..(25): n stands for any nucleotide and can be optionally absent
uaagaggacugaugaggnnnnnnnnccgaaauuucgug

SEQ ID NO: 6135 - RNA, 38 nt, Artificial Sequence
  Description of Artificial Sequence:  Enzymatic Nucleic Acid
  misc_feature (18)..(25): n stands for any nucleotide and can be optionally absent
gauaagagcugaugaggnnnnnnnnccgaaauauuucg

SEQ ID NO: 6136 - RNA, 38 nt, Artificial Sequence
  Description of Artificial Sequence:  Enzymatic Nucleic Acid
  misc_feature (18)..(25): n stands for any nucleotide and can be optionally absent
uccgauaacugaugaggnnnnnnnnccgaaaggauauu

SEQ ID NO: 6137 - RNA, 38 nt, Artificial Sequence
  Description of Artificial Sequence:  Enzymatic Nucleic Acid
  misc_feature (18)..(25): n stands for any nucleotide and can be optionally absent
ucuccgaucugaugaggnnnnnnnnccgaaagaggaua

SEQ ID NO: 6138 - RNA, 38 nt, Artificial Sequence
  Description of Artificial Sequence:  Enzymatic Nucleic Acid
  misc_feature (18)..(25): n stands for any nucleotide and can be optionally absent
uucuccgacugaugaggnnnnnnnnccgaaaagaggau

SEQ ID NO: 6139 - RNA, 38 nt, Artificial Sequence
  Description of Artificial Sequence:  Enzymatic Nucleic Acid
  misc_feature (18)..(25): n stands for any nucleotide and can be optionally absent
ucuucucccugaugaggnnnnnnnnccgaaauaagagg

SEQ ID NO: 6140 - RNA, 38 nt, Artificial Sequence
  Description of Artificial Sequence:  Enzymatic Nucleic Acid
  misc_feature (18)..(25): n stands for any nucleotide and can be optionally absent
cagauuuucugaugaggnnnnnnnnccgaaaccacguu

SEQ ID NO: 6141 - RNA, 38 nt, Artificial Sequence
  Description of Artificial Sequence:  Enzymatic Nucleic Acid
  misc_feature (18)..(25): n stands for any nucleotide and can be optionally absent
acagauuucugaugaggnnnnnnnnccgaaaaccacgu

SEQ ID NO: 6142 - RNA, 38 nt, Artificial Sequence
  Description of Artificial Sequence:  Enzymatic Nucleic Acid
  misc_feature (18)..(25): n stands for any nucleotide and can be optionally absent
aagucacacugaugaggnnnnnnnnccgaaauuuuaac

SEQ ID NO: 6143 - RNA, 38 nt, Artificial Sequence
  Description of Artificial Sequence:  Enzymatic Nucleic Acid
  misc_feature (18)..(25): n stands for any nucleotide and can be optionally absent
ccaagccacugaugaggnnnnnnnnccgaaagucacag

SEQ ID NO: 6144 - RNA, 38 nt, Artificial Sequence
  Description of Artificial Sequence:  Enzymatic Nucleic Acid
  misc_feature (18)..(25): n stands for any nucleotide and can be optionally absent
gccaagcccugaugaggnnnnnnnnccgaaaagucaca

SEQ ID NO: 6145 - RNA, 38 nt, Artificial Sequence
  Description of Artificial Sequence:  Enzymatic Nucleic Acid
  misc_feature (18)..(25): n stands for any nucleotide and can be optionally absent
cccgggcccugaugaggnnnnnnnnccgaaagccaaag

SEQ ID NO: 6146 - RNA, 38 nt, Artificial Sequence
  Description of Artificial Sequence:  Enzymatic Nucleic Acid
  misc_feature (18)..(25): n stands for any nucleotide and can be optionally absent
uuuauaaacugaugaggnnnnnnnnccgaaaucccggg

SEQ ID NO: 6147 - RNA, 38 nt, Artificial Sequence
  Description of Artificial Sequence:  Enzymatic Nucleic Acid
  misc_feature (18)..(25): n stands for any nucleotide and can be optionally absent
ucuuuauacugaugaggnnnnnnnnccgaaauaucccg

SEQ ID NO: 6148 - RNA, 38 nt, Artificial Sequence
  Description of Artificial Sequence:  Enzymatic Nucleic Acid
  misc_feature (18)..(25): n stands for any nucleotide and can be optionally absent
aucuuuaucugaugaggnnnnnnnnccgaaaauauccc

SEQ ID NO: 6149 - RNA, 38 nt, Artificial Sequence
  Description of Artificial Sequence:  Enzymatic Nucleic Acid
  misc_feature (18)..(25): n stands for any nucleotide and can be optionally absent
gaucuuuacugaugaggnnnnnnnnccgaaaaauaucc

SEQ ID NO: 6150 - RNA, 38 nt, Artificial Sequence
  Description of Artificial Sequence:  Enzymatic Nucleic Acid
  misc_feature (18)..(25): n stands for any nucleotide and can be optionally absent
uggaucuucugaugaggnnnnnnnnccgaaauaaauau

SEQ ID NO: 6151 - RNA, 38 nt, Artificial Sequence
  Description of Artificial Sequence:  Enzymatic Nucleic Acid
  misc_feature (18)..(25): n stands for any nucleotide and can be optionally absent
auaaucugcugaugaggnnnnnnnnccgaaaucuuuau

SEQ ID NO: 6152 - RNA, 38 nt, Artificial Sequence
  Description of Artificial Sequence:  Enzymatic Nucleic Acid
  misc_feature (18)..(25): n stands for any nucleotide and can be optionally absent
ucugacaucugaugaggnnnnnnnnccgaaaucuggau

SEQ ID NO: 6153 - RNA, 38 nt, Artificial Sequence
  Description of Artificial Sequence:  Enzymatic Nucleic Acid
  misc_feature (18)..(25): n stands for any nucleotide and can be optionally absent
uucugacacugaugaggnnnnnnnnccgaaaaucugga

SEQ ID NO: 6154 - RNA, 38 nt, Artificial Sequence
  Description of Artificial Sequence:  Enzymatic Nucleic Acid
  misc_feature (18)..(25): n stands for any nucleotide and can be optionally absent
ccuuuucucugaugaggnnnnnnnnccgaaacauaauc

SEQ ID NO: 6155 - RNA, 38 nt, Artificial Sequence
  Description of Artificial Sequence:  Enzymatic Nucleic Acid
  misc_feature (18)..(25): n stands for any nucleotide and can be optionally absent
agggaggccugaugaggnnnnnnnnccgaaagcaucuc

SEQ ID NO: 6156 - RNA, 38 nt, Artificial Sequence
  Description of Artificial Sequence:  Enzymatic Nucleic Acid
  misc_feature (18)..(25): n stands for any nucleotide and can be optionally absent
uucaaaggcugaugaggnnnnnnnnccgaaaggcgagc

SEQ ID NO: 6157 - RNA, 38 nt, Artificial Sequence
  Description of Artificial Sequence:  Enzymatic Nucleic Acid
  misc_feature (18)..(25): n stands for any nucleotide and can be optionally absent
ccauuucacugaugaggnnnnnnnnccgaaagggaggc

SEQ ID NO: 6158 - RNA, 38 nt, Artificial Sequence
  Description of Artificial Sequence:  Enzymatic Nucleic Acid
  misc_feature (18)..(25): n stands for any nucleotide and can be optionally absent
uccauuuccugaugaggnnnnnnnnccgaaaagggagg

SEQ ID NO: 6159 - RNA, 38 nt, Artificial Sequence
  Description of Artificial Sequence:  Enzymatic Nucleic Acid
  misc_feature (18)..(25): n stands for any nucleotide and can be optionally absent
cugucaaacugaugaggnnnnnnnnccgaaauuguuuc

SEQ ID NO: 6160 - RNA, 38 nt, Artificial Sequence
  Description of Artificial Sequence:  Enzymatic Nucleic Acid
  misc_feature (18)..(25): n stands for any nucleotide and can be optionally absent
ucugucaacugaugaggnnnnnnnnccgaaaauuguuu

SEQ ID NO: 6161 - RNA, 38 nt, Artificial Sequence
  Description of Artificial Sequence:  Enzymatic Nucleic Acid
  misc_feature (18)..(25): n stands for any nucleotide and can be optionally absent
cucugucacugaugaggnnnnnnnnccgaaaaauuguu

SEQ ID NO: 6162 - RNA, 38 nt, Artificial Sequence
  Description of Artificial Sequence:  Enzymatic Nucleic Acid
  misc_feature (18)..(25): n stands for any nucleotide and can be optionally absent
acucuguccugaugaggnnnnnnnnccgaaaaaauugu

SEQ ID NO: 6163 - RNA, 38 nt, Artificial Sequence
  Description of Artificial Sequence:  Enzymatic Nucleic Acid
  misc_feature (18)..(25): n stands for any nucleotide and can be optionally absent
ggauugugcugaugaggnnnnnnnnccgaaacacucug

SEQ ID NO: 6164 - RNA, 38 nt, Artificial Sequence
  Description of Artificial Sequence:  Enzymatic Nucleic Acid
  misc_feature (18)..(25): n stands for any nucleotide and can be optionally absent
ucacucugcugaugaggnnnnnnnnccgaaauugugua

SEQ ID NO: 6165 - RNA, 38 nt, Artificial Sequence
  Description of Artificial Sequence:  Enzymatic Nucleic Acid
  misc_feature (18)..(25): n stands for any nucleotide and can be optionally absent
aaagaccacugaugaggnnnnnnnnccgaaacgucacu

SEQ ID NO: 6166 - RNA, 38 nt, Artificial Sequence
  Description of Artificial Sequence:  Enzymatic Nucleic Acid
  misc_feature (18)..(25): n stands for any nucleotide and can be optionally absent
caccaaaacugaugaggnnnnnnnnccgaaaccagacg

SEQ ID NO: 6167 - RNA, 38 nt, Artificial Sequence
  Description of Artificial Sequence:  Enzymatic Nucleic Acid
  misc_feature (18)..(25): n stands for any nucleotide and can be optionally absent
aacaccaacugaugaggnnnnnnnnccgaaagaccaga

SEQ ID NO: 6168 - RNA, 38 nt, Artificial Sequence
  Description of Artificial Sequence:  Enzymatic Nucleic Acid
  misc_feature (18)..(25): n stands for any nucleotide and can be optionally absent
aaacaccacugaugaggnnnnnnnnccgaaaagaccag

SEQ ID NO: 6169 - RNA, 38 nt, Artificial Sequence
  Description of Artificial Sequence:  Enzymatic Nucleic Acid
  misc_feature (18)..(25): n stands for any nucleotide and can be optionally absent
aaaacacccugaugaggnnnnnnnnccgaaaaagacca

SEQ ID NO: 6170 - RNA, 38 nt, Artificial Sequence
  Description of Artificial Sequence:  Enzymatic Nucleic Acid
  misc_feature (18)..(25): n stands for any nucleotide and can be optionally absent
cacagcaacugaugaggnnnnnnnnccgaaacaccaaa

SEQ ID NO: 6171 - RNA, 38 nt, Artificial Sequence
  Description of Artificial Sequence:  Enzymatic Nucleic Acid
  misc_feature (18)..(25): n stands for any nucleotide and can be optionally absent
ccacagcacugaugaggnnnnnnnnccgaaaacaccaa

SEQ ID NO: 6172 - RNA, 38 nt, Artificial Sequence
  Description of Artificial Sequence:  Enzymatic Nucleic Acid
  misc_feature (18)..(25): n stands for any nucleotide and can be optionally absent
cccacagccugaugaggnnnnnnnnccgaaaaacacca

SEQ ID NO: 6173 - RNA, 38 nt, Artificial Sequence
  Description of Artificial Sequence:  Enzymatic Nucleic Acid
  misc_feature (18)..(25): n stands for any nucleotide and can be optionally absent
aaggaaaacugaugaggnnnnnnnnccgaaauuuccca

SEQ ID NO: 6174 - RNA, 38 nt, Artificial Sequence
  Description of Artificial Sequence:  Enzymatic Nucleic Acid
  misc_feature (18)..(25): n stands for any nucleotide and can be optionally absent
cuaaggaacugaugaggnnnnnnnnccgaaauauuucc

SEQ ID NO: 6175 - RNA, 38 nt, Artificial Sequence
  Description of Artificial Sequence:  Enzymatic Nucleic Acid
  misc_feature (18)..(25): n stands for any nucleotide and can be optionally absent
ccuaaggacugaugaggnnnnnnnnccgaaaauauuuc

SEQ ID NO: 6176 - RNA, 38 nt, Artificial Sequence
  Description of Artificial Sequence:  Enzymatic Nucleic Acid
  misc_feature (18)..(25): n stands for any nucleotide and can be optionally absent
accuaaggcugaugaggnnnnnnnnccgaaaaauauuu

SEQ ID NO: 6177 - RNA, 38 nt, Artificial Sequence
  Description of Artificial Sequence:  Enzymatic Nucleic Acid
  misc_feature (18)..(25): n stands for any nucleotide and can be optionally absent
caccuaagcugaugaggnnnnnnnnccgaaaaaauauu

SEQ ID NO: 6178 - RNA, 38 nt, Artificial Sequence
  Description of Artificial Sequence:  Enzymatic Nucleic Acid
  misc_feature (18)..(25): n stands for any nucleotide and can be optionally absent
aagcaccucugaugaggnnnnnnnnccgaaaggaaaau

SEQ ID NO: 6179 - RNA, 38 nt, Artificial Sequence
  Description of Artificial Sequence:  Enzymatic Nucleic Acid
  misc_feature (18)..(25): n stands for any nucleotide and can be optionally absent
gaagcacccugaugaggnnnnnnnnccgaaaaggaaaa

SEQ ID NO: 6180 - RNA, 38 nt, Artificial Sequence
  Description of Artificial Sequence:  Enzymatic Nucleic Acid
  misc_feature (18)..(25): n stands for any nucleotide and can be optionally absent
auauggagcugaugaggnnnnnnnnccgaaagcaccua

SEQ ID NO: 6181 - RNA, 38 nt, Artificial Sequence
  Description of Artificial Sequence:  Enzymatic Nucleic Acid
  misc_feature (18)..(25): n stands for any nucleotide and can be optionally absent
gauauggacugaugaggnnnnnnnnccgaaaagcaccu

SEQ ID NO: 6182 - RNA, 38 nt, Artificial Sequence
  Description of Artificial Sequence:  Enzymatic Nucleic Acid
  misc_feature (18)..(25): n stands for any nucleotide and can be optionally absent
aggauaugcugaugaggnnnnnnnnccgaaagaagcac

SEQ ID NO: 6183 - RNA, 38 nt, Artificial Sequence
  Description of Artificial Sequence:  Enzymatic Nucleic Acid
  misc_feature (18)..(25): n stands for any nucleotide and can be optionally absent
ccccaggacugaugaggnnnnnnnnccgaaauggagaa

SEQ ID NO: 6184 - RNA, 38 nt, Artificial Sequence
  Description of Artificial Sequence:  Enzymatic Nucleic Acid
  misc_feature (18)..(25): n stands for any nucleotide and can be optionally absent
uaccccagcugaugaggnnnnnnnnccgaaauauggag

SEQ ID NO: 6185 - RNA, 38 nt, Artificial Sequence
  Description of Artificial Sequence:  Enzymatic Nucleic Acid
  misc_feature (18)..(25): n stands for any nucleotide and can be optionally absent
ucaaucuucugaugaggnnnnnnnnccgaaaccccagg

SEQ ID NO: 6186 - RNA, 38 nt, Artificial Sequence
  Description of Artificial Sequence:  Enzymatic Nucleic Acid
  misc_feature (18)..(25): n stands for any nucleotide and can be optionally absent
ucuucauccugaugaggnnnnnnnnccgaaaucuuuac

SEQ ID NO: 6187 - RNA, 38 nt, Artificial Sequence
  Description of Artificial Sequence:  Enzymatic Nucleic Acid
  misc_feature (18)..(25): n stands for any nucleotide and can be optionally absent
gccuacaacugaugaggnnnnnnnnccgaaauucuuca

SEQ ID NO: 6188 - RNA, 38 nt, Artificial Sequence
  Description of Artificial Sequence:  Enzymatic Nucleic Acid
  misc_feature (18)..(25): n stands for any nucleotide and can be optionally absent
cgccuacacugaugaggnnnnnnnnccgaaaauucuuc

SEQ ID NO: 6189 - RNA, 38 nt, Artificial Sequence
  Description of Artificial Sequence:  Enzymatic Nucleic Acid
  misc_feature (18)..(25): n stands for any nucleotide and can be optionally absent
ucgccuaccugaugaggnnnnnnnnccgaaaaauucuu

SEQ ID NO: 6190 - RNA, 38 nt, Artificial Sequence
  Description of Artificial Sequence:  Enzymatic Nucleic Acid
  misc_feature (18)..(25): n stands for any nucleotide and can be optionally absent
caaucgcccugaugaggnnnnnnnnccgaaacaaaauu

SEQ ID NO: 6191 - RNA, 38 nt, Artificial Sequence
  Description of Artificial Sequence:  Enzymatic Nucleic Acid
  misc_feature (18)..(25): n stands for any nucleotide and can be optionally absent
cuucuuuccugaugaggnnnnnnnnccgaaaucgccua

SEQ ID NO: 6192 - RNA, 38 nt, Artificial Sequence
  Description of Artificial Sequence:  Enzymatic Nucleic Acid
  misc_feature (18)..(25): n stands for any nucleotide and can be optionally absent
ccucauuccugaugaggnnnnnnnnccgaaaguuccuu

SEQ ID NO: 6193 - RNA, 38 nt, Artificial Sequence
  Description of Artificial Sequence:  Enzymatic Nucleic Acid
  misc_feature (18)..(25): n stands for any nucleotide and can be optionally absent
uguaguaucugaugaggnnnnnnnnccgaaaucagggg

SEQ ID NO: 6194 - RNA, 38 nt, Artificial Sequence
  Description of Artificial Sequence:  Enzymatic Nucleic Acid
  misc_feature (18)..(25): n stands for any nucleotide and can be optionally absent
guguaguacugaugaggnnnnnnnnccgaaaaucaggg

SEQ ID NO: 6195 - RNA, 38 nt, Artificial Sequence
  Description of Artificial Sequence:  Enzymatic Nucleic Acid
  misc_feature (18)..(25): n stands for any nucleotide and can be optionally absent
ugguguagcugaugaggnnnnnnnnccgaaauaaucag

SEQ ID NO: 6196 - RNA, 38 nt, Artificial Sequence
  Description of Artificial Sequence:  Enzymatic Nucleic Acid
  misc_feature (18)..(25): n stands for any nucleotide and can be optionally absent
uucuggugcugaugaggnnnnnnnnccgaaaguauaau

SEQ ID NO: 6197 - RNA, 38 nt, Artificial Sequence
  Description of Artificial Sequence:  Enzymatic Nucleic Acid
  misc_feature (18)..(25): n stands for any nucleotide and can be optionally absent
uggucuggcugaugaggnnnnnnnnccgaaacauuucu

SEQ ID NO: 6198 - RNA, 38 nt, Artificial Sequence
  Description of Artificial Sequence:  Enzymatic Nucleic Acid
  misc_feature (18)..(25): n stands for any nucleotide and can be optionally absent
gggucucucugaugaggnnnnnnnnccgaaacugggcu

SEQ ID NO: 6199 - RNA, 38 nt, Artificial Sequence
  Description of Artificial Sequence:  Enzymatic Nucleic Acid
  misc_feature (18)..(25): n stands for any nucleotide and can be optionally absent
acucugaacugaugaggnnnnnnnnccgaaacgugggu

SEQ ID NO: 6200 - RNA, 38 nt, Artificial Sequence
  Description of Artificial Sequence:  Enzymatic Nucleic Acid
  misc_feature (18)..(25): n stands for any nucleotide and can be optionally absent
aacucugacugaugaggnnnnnnnnccgaaaacguggg

SEQ ID NO: 6201 - RNA, 38 nt, Artificial Sequence
  Description of Artificial Sequence:  Enzymatic Nucleic Acid
  misc_feature (18)..(25): n stands for any nucleotide and can be optionally absent
caacucugcugaugaggnnnnnnnnccgaaaaacgugg

SEQ ID NO: 6202 - RNA, 38 nt, Artificial Sequence
  Description of Artificial Sequence:  Enzymatic Nucleic Acid
  misc_feature (18)..(25): n stands for any nucleotide and can be optionally absent
ccaacucucugaugaggnnnnnnnnccgaaaaaacgug

SEQ ID NO: 6203 - RNA, 38 nt, Artificial Sequence
  Description of Artificial Sequence:  Enzymatic Nucleic Acid
  misc_feature (18)..(25): n stands for any nucleotide and can be optionally absent
guuccacccugaugaggnnnnnnnnccgaaacucugaa

SEQ ID NO: 6204 - RNA, 38 nt, Artificial Sequence
  Description of Artificial Sequence:  Enzymatic Nucleic Acid
  misc_feature (18)..(25): n stands for any nucleotide and can be optionally absent
auuucccacugaugaggnnnnnnnnccgaaauguucca

SEQ ID NO: 6205 - RNA, 38 nt, Artificial Sequence
  Description of Artificial Sequence:  Enzymatic Nucleic Acid
  misc_feature (18)..(25): n stands for any nucleotide and can be optionally absent
gauuuccccugaugaggnnnnnnnnccgaaaauguucc

SEQ ID NO: 6206 - RNA, 38 nt, Artificial Sequence
  Description of Artificial Sequence:  Enzymatic Nucleic Acid
  misc_feature (18)..(25): n stands for any nucleotide and can be optionally absent
uugcaagacugaugaggnnnnnnnnccgaaauuuccca

SEQ ID NO: 6207 - RNA, 38 nt, Artificial Sequence
  Description of Artificial Sequence:  Enzymatic Nucleic Acid
  misc_feature (18)..(25): n stands for any nucleotide and can be optionally absent
gcuugcaacugaugaggnnnnnnnnccgaaagauuucc

SEQ ID NO: 6208 - RNA, 38 nt, Artificial Sequence
  Description of Artificial Sequence:  Enzymatic Nucleic Acid
  misc_feature (18)..(25): n stands for any nucleotide and can be optionally absent
uagcuugccugaugaggnnnnnnnnccgaaagagauuu

SEQ ID NO: 6209 - RNA, 38 nt, Artificial Sequence
  Description of Artificial Sequence:  Enzymatic Nucleic Acid
  misc_feature (18)..(25): n stands for any nucleotide and can be optionally absent
cugagcaucugaugaggnnnnnnnnccgaaagcuugca

SEQ ID NO: 6210 - RNA, 38 nt, Artificial Sequence
  Description of Artificial Sequence:  Enzymatic Nucleic Acid
  misc_feature (18)..(25): n stands for any nucleotide and can be optionally absent
auccugcucugaugaggnnnnnnnnccgaaagcauuag

SEQ ID NO: 6211 - RNA, 38 nt, Artificial Sequence
  Description of Artificial Sequence:  Enzymatic Nucleic Acid
  misc_feature (18)..(25): n stands for any nucleotide and can be optionally absent
gaacaaugcugaugaggnnnnnnnnccgaaagucuuug

SEQ ID NO: 6212 - RNA, 38 nt, Artificial Sequence
  Description of Artificial Sequence:  Enzymatic Nucleic Acid
  misc_feature (18)..(25): n stands for any nucleotide and can be optionally absent
ggaagaaccugaugaggnnnnnnnnccgaaauguaguc

SEQ ID NO: 6213 - RNA, 38 nt, Artificial Sequence
  Description of Artificial Sequence:  Enzymatic Nucleic Acid
  misc_feature (18)..(25): n stands for any nucleotide and can be optionally absent
aucggaagcugaugaggnnnnnnnnccgaaacaaugua

SEQ ID NO: 6214 - RNA, 38 nt, Artificial Sequence
  Description of Artificial Sequence:  Enzymatic Nucleic Acid
  misc_feature (18)..(25): n stands for any nucleotide and can be optionally absent
uaucggaacugaugaggnnnnnnnnccgaaaacaaugu

SEQ ID NO: 6215 - RNA, 38 nt, Artificial Sequence
  Description of Artificial Sequence:  Enzymatic Nucleic Acid
  misc_feature (18)..(25): n stands for any nucleotide and can be optionally absent
gauaucggcugaugaggnnnnnnnnccgaaagaacaau

SEQ ID NO: 6216 - RNA, 38 nt, Artificial Sequence
  Description of Artificial Sequence:  Enzymatic Nucleic Acid
  misc_feature (18)..(25): n stands for any nucleotide and can be optionally absent
ugauaucgcugaugaggnnnnnnnnccgaaaagaacaa

SEQ ID NO: 6217 - RNA, 38 nt, Artificial Sequence
  Description of Artificial Sequence:  Enzymatic Nucleic Acid
  misc_feature (18)..(25): n stands for any nucleotide and can be optionally absent
gucucugacugaugaggnnnnnnnnccgaaaucggaag

SEQ ID NO: 6218 - RNA, 38 nt, Artificial Sequence
  Description of Artificial Sequence:  Enzymatic Nucleic Acid
  misc_feature (18)..(25): n stands for any nucleotide and can be optionally absent
aagucucucugaugaggnnnnnnnnccgaaauaucgga

SEQ ID NO: 6219 - RNA, 38 nt, Artificial Sequence
  Description of Artificial Sequence:  Enzymatic Nucleic Acid
  misc_feature (18)..(25): n stands for any nucleotide and can be optionally absent
caugcucacugaugaggnnnnnnnnccgaaagucucug

SEQ ID NO: 6220 - RNA, 38 nt, Artificial Sequence
  Description of Artificial Sequence:  Enzymatic Nucleic Acid
  misc_feature (18)..(25): n stands for any nucleotide and can be optionally absent
ccaugcuccugaugaggnnnnnnnnccgaaaagucucu

SEQ ID NO: 6221 - RNA, 38 nt, Artificial Sequence
  Description of Artificial Sequence:  Enzymatic Nucleic Acid
  misc_feature (18)..(25): n stands for any nucleotide and can be optionally absent
gaguccagcugaugaggnnnnnnnnccgaaauccucuu

SEQ ID NO: 6222 - RNA, 38 nt, Artificial Sequence
  Description of Artificial Sequence:  Enzymatic Nucleic Acid
  misc_feature (18)..(25): n stands for any nucleotide and can be optionally absent
agaguccacugaugaggnnnnnnnnccgaaaauccucu

SEQ ID NO: 6223 - RNA, 38 nt, Artificial Sequence
  Description of Artificial Sequence:  Enzymatic Nucleic Acid
  misc_feature (18)..(25): n stands for any nucleotide and can be optionally absent
ggcagagacugaugaggnnnnnnnnccgaaaguccaga

SEQ ID NO: 6224 - RNA, 38 nt, Artificial Sequence
  Description of Artificial Sequence:  Enzymatic Nucleic Acid
  misc_feature (18)..(25): n stands for any nucleotide and can be optionally absent
uaggcagacugaugaggnnnnnnnnccgaaagagucca

SEQ ID NO: 6225 - RNA, 38 nt, Artificial Sequence
  Description of Artificial Sequence:  Enzymatic Nucleic Acid
  misc_feature (18)..(25): n stands for any nucleotide and can be optionally absent
gguaggcacugaugaggnnnnnnnnccgaaagagaguc

SEQ ID NO: 6226 - RNA, 38 nt, Artificial Sequence
  Description of Artificial Sequence:  Enzymatic Nucleic Acid
  misc_feature (18)..(25): n stands for any nucleotide and can be optionally absent
aggugaggcugaugaggnnnnnnnnccgaaaggcagag

SEQ ID NO: 6227 - RNA, 38 nt, Artificial Sequence
  Description of Artificial Sequence:  Enzymatic Nucleic Acid
  misc_feature (18)..(25): n stands for any nucleotide and can be optionally absent
aaacaggucugaugaggnnnnnnnnccgaaagguaggc

SEQ ID NO: 6228 - RNA, 38 nt, Artificial Sequence
  Description of Artificial Sequence:  Enzymatic Nucleic Acid
  misc_feature (18)..(25): n stands for any nucleotide and can be optionally absent
auacaggacugaugaggnnnnnnnnccgaaacagguga

SEQ ID NO: 6229 - RNA, 38 nt, Artificial Sequence
  Description of Artificial Sequence:  Enzymatic Nucleic Acid
  misc_feature (18)..(25): n stands for any nucleotide and can be optionally absent
cauacaggcugaugaggnnnnnnnnccgaaaacaggug

SEQ ID NO: 6230 - RNA, 38 nt, Artificial Sequence
  Description of Artificial Sequence:  Enzymatic Nucleic Acid
  misc_feature (18)..(25): n stands for any nucleotide and can be optionally absent
ccauacagcugaugaggnnnnnnnnccgaaaaacaggu

SEQ ID NO: 6231 - RNA, 38 nt, Artificial Sequence
  Description of Artificial Sequence:  Enzymatic Nucleic Acid
  misc_feature (18)..(25): n stands for any nucleotide and can be optionally absent
cuccuccacugaugaggnnnnnnnnccgaaacaggaaa

SEQ ID NO: 6232 - RNA, 38 nt, Artificial Sequence
  Description of Artificial Sequence:  Enzymatic Nucleic Acid
  misc_feature (18)..(25): n stands for any nucleotide and can be optionally absent
gggucacacugaugaggnnnnnnnnccgaaacuuccuc

SEQ ID NO: 6233 - RNA, 38 nt, Artificial Sequence
  Description of Artificial Sequence:  Enzymatic Nucleic Acid
  misc_feature (18)..(25): n stands for any nucleotide and can be optionally absent
cauaauggcugaugaggnnnnnnnnccgaaauuugggg

SEQ ID NO: 6234 - RNA, 38 nt, Artificial Sequence
  Description of Artificial Sequence:  Enzymatic Nucleic Acid
  misc_feature (18)..(25): n stands for any nucleotide and can be optionally absent
ucauaaugcugaugaggnnnnnnnnccgaaaauuuggg

SEQ ID NO: 6235 - RNA, 38 nt, Artificial Sequence
  Description of Artificial Sequence:  Enzymatic Nucleic Acid
  misc_feature (18)..(25): n stands for any nucleotide and can be optionally absent
guugucaucugaugaggnnnnnnnnccgaaauggaauu

SEQ ID NO: 6236 - RNA, 38 nt, Artificial Sequence
  Description of Artificial Sequence:  Enzymatic Nucleic Acid
  misc_feature (18)..(25): n stands for any nucleotide and can be optionally absent
uguugucacugaugaggnnnnnnnnccgaaaauggaau

SEQ ID NO: 6237 - RNA, 38 nt, Artificial Sequence
  Description of Artificial Sequence:  Enzymatic Nucleic Acid
  misc_feature (18)..(25): n stands for any nucleotide and can be optionally absent
uacugacucugaugaggnnnnnnnnccgaaauuccugc

SEQ ID NO: 6238 - RNA, 38 nt, Artificial Sequence
  Description of Artificial Sequence:  Enzymatic Nucleic Acid
  misc_feature (18)..(25): n stands for any nucleotide and can be optionally absent
cagauacucugaugaggnnnnnnnnccgaaacugauuc

SEQ ID NO: 6239 - RNA, 38 nt, Artificial Sequence
  Description of Artificial Sequence:  Enzymatic Nucleic Acid
  misc_feature (18)..(25): n stands for any nucleotide and can be optionally absent
ucugcagacugaugaggnnnnnnnnccgaaacugacug

SEQ ID NO: 6240 - RNA, 38 nt, Artificial Sequence
  Description of Artificial Sequence:  Enzymatic Nucleic Acid
  misc_feature (18)..(25): n stands for any nucleotide and can be optionally absent
guucugcacugaugaggnnnnnnnnccgaaauacugac

SEQ ID NO: 6241 - RNA, 38 nt, Artificial Sequence
  Description of Artificial Sequence:  Enzymatic Nucleic Acid
  misc_feature (18)..(25): n stands for any nucleotide and can be optionally absent
cuuucgcucugaugaggnnnnnnnnccgaaacuguucu

SEQ ID NO: 6242 - RNA, 38 nt, Artificial Sequence
  Description of Artificial Sequence:  Enzymatic Nucleic Acid
  misc_feature (18)..(25): n stands for any nucleotide and can be optionally absent
aauguuuucugaugaggnnnnnnnnccgaaacacucac

SEQ ID NO: 6243 - RNA, 38 nt, Artificial Sequence
  Description of Artificial Sequence:  Enzymatic Nucleic Acid
  misc_feature (18)..(25): n stands for any nucleotide and can be optionally absent
uaucuucacugaugaggnnnnnnnnccgaaauguuuuu

SEQ ID NO: 6244 - RNA, 38 nt, Artificial Sequence
  Description of Artificial Sequence:  Enzymatic Nucleic Acid
  misc_feature (18)..(25): n stands for any nucleotide and can be optionally absent
auaucuuccugaugaggnnnnnnnnccgaaaauguuuu

SEQ ID NO: 6245 - RNA, 38 nt, Artificial Sequence
  Description of Artificial Sequence:  Enzymatic Nucleic Acid
  misc_feature (18)..(25): n stands for any nucleotide and can be optionally absent
uaacgggacugaugaggnnnnnnnnccgaaaucuucaa

SEQ ID NO: 6246 - RNA, 38 nt, Artificial Sequence
  Description of Artificial Sequence:  Enzymatic Nucleic Acid
  misc_feature (18)..(25): n stands for any nucleotide and can be optionally absent
ucuaacggcugaugaggnnnnnnnnccgaaauaucuuc

SEQ ID NO: 6247 - RNA, 38 nt, Artificial Sequence
  Description of Artificial Sequence:  Enzymatic Nucleic Acid
  misc_feature (18)..(25): n stands for any nucleotide and can be optionally absent
guucuucucugaugaggnnnnnnnnccgaaacgggaua

SEQ ID NO: 6248 - RNA, 38 nt, Artificial Sequence
  Description of Artificial Sequence:  Enzymatic Nucleic Acid
  misc_feature (18)..(25): n stands for any nucleotide and can be optionally absent
gguucuuccugaugaggnnnnnnnnccgaaaacgggau

SEQ ID NO: 6249 - RNA, 38 nt, Artificial Sequence
  Description of Artificial Sequence:  Enzymatic Nucleic Acid
  misc_feature (18)..(25): n stands for any nucleotide and can be optionally absent
auuacuuucugaugaggnnnnnnnnccgaaacuucugg

SEQ ID NO: 6250 - RNA, 38 nt, Artificial Sequence
  Description of Artificial Sequence:  Enzymatic Nucleic Acid
  misc_feature (18)..(25): n stands for any nucleotide and can be optionally absent
ucugggaucugaugaggnnnnnnnnccgaaacuuuuac

SEQ ID NO: 6251 - RNA, 38 nt, Artificial Sequence
  Description of Artificial Sequence:  Enzymatic Nucleic Acid
  misc_feature (18)..(25): n stands for any nucleotide and can be optionally absent
ucaucuggcugaugaggnnnnnnnnccgaaauuacuuu

SEQ ID NO: 6252 - RNA, 38 nt, Artificial Sequence
  Description of Artificial Sequence:  Enzymatic Nucleic Acid
  misc_feature (18)..(25): n stands for any nucleotide and can be optionally absent
aagaaccacugaugaggnnnnnnnnccgaaaccacugu

SEQ ID NO: 6253 - RNA, 38 nt, Artificial Sequence
  Description of Artificial Sequence:  Enzymatic Nucleic Acid
  misc_feature (18)..(25): n stands for any nucleotide and can be optionally absent
gaggcaagcugaugaggnnnnnnnnccgaaaccauacc

SEQ ID NO: 6254 - RNA, 38 nt, Artificial Sequence
  Description of Artificial Sequence:  Enzymatic Nucleic Acid
  misc_feature (18)..(25): n stands for any nucleotide and can be optionally absent
ugaggcaacugaugaggnnnnnnnnccgaaaaccauac

SEQ ID NO: 6255 - RNA, 38 nt, Artificial Sequence
  Description of Artificial Sequence:  Enzymatic Nucleic Acid
  misc_feature (18)..(25): n stands for any nucleotide and can be optionally absent
ucugaggccugaugaggnnnnnnnnccgaaagaaccau

SEQ ID NO: 6256 - RNA, 38 nt, Artificial Sequence
  Description of Artificial Sequence:  Enzymatic Nucleic Acid
  misc_feature (18)..(25): n stands for any nucleotide and can be optionally absent
gcucuucucugaugaggnnnnnnnnccgaaaggcaaga

SEQ ID NO: 6257 - RNA, 38 nt, Artificial Sequence
  Description of Artificial Sequence:  Enzymatic Nucleic Acid
  misc_feature (18)..(25): n stands for any nucleotide and can be optionally absent
gucuuccacugaugaggnnnnnnnnccgaaaguuuuca

SEQ ID NO: 6258 - RNA, 38 nt, Artificial Sequence
  Description of Artificial Sequence:  Enzymatic Nucleic Acid
  misc_feature (18)..(25): n stands for any nucleotide and can be optionally absent
ugucuucccugaugaggnnnnnnnnccgaaaaguuuuc

SEQ ID NO: 6259 - RNA, 38 nt, Artificial Sequence
  Description of Artificial Sequence:  Enzymatic Nucleic Acid
  misc_feature (18)..(25): n stands for any nucleotide and can be optionally absent
auggagaucugaugaggnnnnnnnnccgaaauuugguu

SEQ ID NO: 6260 - RNA, 38 nt, Artificial Sequence
  Description of Artificial Sequence:  Enzymatic Nucleic Acid
  misc_feature (18)..(25): n stands for any nucleotide and can be optionally absent
gauggagacugaugaggnnnnnnnnccgaaaauuuggu

SEQ ID NO: 6261 - RNA, 38 nt, Artificial Sequence
  Description of Artificial Sequence:  Enzymatic Nucleic Acid
  misc_feature (18)..(25): n stands for any nucleotide and can be optionally absent
aagauggacugaugaggnnnnnnnnccgaaauaauuug

SEQ ID NO: 6262 - RNA, 38 nt, Artificial Sequence
  Description of Artificial Sequence:  Enzymatic Nucleic Acid
  misc_feature (18)..(25): n stands for any nucleotide and can be optionally absent
aaaagaugcugaugaggnnnnnnnnccgaaagauaauu

SEQ ID NO: 6263 - RNA, 38 nt, Artificial Sequence
  Description of Artificial Sequence:  Enzymatic Nucleic Acid
  misc_feature (18)..(25): n stands for any nucleotide and can be optionally absent
caccaaaacugaugaggnnnnnnnnccgaaauggagau

SEQ ID NO: 6264 - RNA, 38 nt, Artificial Sequence
  Description of Artificial Sequence:  Enzymatic Nucleic Acid
  misc_feature (18)..(25): n stands for any nucleotide and can be optionally absent
uccaccaacugaugaggnnnnnnnnccgaaagauggag

SEQ ID NO: 6265 - RNA, 38 nt, Artificial Sequence
  Description of Artificial Sequence:  Enzymatic Nucleic Acid
  misc_feature (18)..(25): n stands for any nucleotide and can be optionally absent
uuccaccacugaugaggnnnnnnnnccgaaaagaugga

SEQ ID NO: 6266 - RNA, 38 nt, Artificial Sequence
  Description of Artificial Sequence:  Enzymatic Nucleic Acid
  misc_feature (18)..(25): n stands for any nucleotide and can be optionally absent
auuccacccugaugaggnnnnnnnnccgaaaaagaugg

SEQ ID NO: 6267 - RNA, 38 nt, Artificial Sequence
  Description of Artificial Sequence:  Enzymatic Nucleic Acid
  misc_feature (18)..(25): n stands for any nucleotide and can be optionally absent
augccacacugaugaggnnnnnnnnccgaaacucccug

SEQ ID NO: 6268 - RNA, 38 nt, Artificial Sequence
  Description of Artificial Sequence:  Enzymatic Nucleic Acid
  misc_feature (18)..(25): n stands for any nucleotide and can be optionally absent
agccuucacugaugaggnnnnnnnnccgaaaugccaca

SEQ ID NO: 6269 - RNA, 38 nt, Artificial Sequence
  Description of Artificial Sequence:  Enzymatic Nucleic Acid
  misc_feature (18)..(25): n stands for any nucleotide and can be optionally absent
ucugguuucugaugaggnnnnnnnnccgaaagccuuca

SEQ ID NO: 6270 - RNA, 38 nt, Artificial Sequence
  Description of Artificial Sequence:  Enzymatic Nucleic Acid
  misc_feature (18)..(25): n stands for any nucleotide and can be optionally absent
cggacuggcugaugaggnnnnnnnnccgaaagccgcuu

SEQ ID NO: 6271 - RNA, 38 nt, Artificial Sequence
  Description of Artificial Sequence:  Enzymatic Nucleic Acid
  misc_feature (18)..(25): n stands for any nucleotide and can be optionally absent
gauauccgcugaugaggnnnnnnnnccgaaacugguag

SEQ ID NO: 6272 - RNA, 38 nt, Artificial Sequence
  Description of Artificial Sequence:  Enzymatic Nucleic Acid
  misc_feature (18)..(25): n stands for any nucleotide and can be optionally absent
cggagugacugaugaggnnnnnnnnccgaaauccggac

SEQ ID NO: 6273 - RNA, 38 nt, Artificial Sequence
  Description of Artificial Sequence:  Enzymatic Nucleic Acid
  misc_feature (18)..(25): n stands for any nucleotide and can be optionally absent
aucggagucugaugaggnnnnnnnnccgaaauauccgg

SEQ ID NO: 6274 - RNA, 38 nt, Artificial Sequence
  Description of Artificial Sequence:  Enzymatic Nucleic Acid
  misc_feature (18)..(25): n stands for any nucleotide and can be optionally absent
ugucaucgcugaugaggnnnnnnnnccgaaagugauau

SEQ ID NO: 6275 - RNA, 38 nt, Artificial Sequence
  Description of Artificial Sequence:  Enzymatic Nucleic Acid
  misc_feature (18)..(25): n stands for any nucleotide and can be optionally absent
cacuggagcugaugaggnnnnnnnnccgaaacacggug

SEQ ID NO: 6276 - RNA, 38 nt, Artificial Sequence
  Description of Artificial Sequence:  Enzymatic Nucleic Acid
  misc_feature (18)..(25): n stands for any nucleotide and can be optionally absent
ccucacugcugaugaggnnnnnnnnccgaaaguacacg

SEQ ID NO: 6277 - RNA, 38 nt, Artificial Sequence
  Description of Artificial Sequence:  Enzymatic Nucleic Acid
  misc_feature (18)..(25): n stands for any nucleotide and can be optionally absent
agcuuuaacugaugaggnnnnnnnnccgaaaguucugc

SEQ ID NO: 6278 - RNA, 38 nt, Artificial Sequence
  Description of Artificial Sequence:  Enzymatic Nucleic Acid
  misc_feature (18)..(25): n stands for any nucleotide and can be optionally absent
cagcuuuacugaugaggnnnnnnnnccgaaaaguucug

SEQ ID NO: 6279 - RNA, 38 nt, Artificial Sequence
  Description of Artificial Sequence:  Enzymatic Nucleic Acid
  misc_feature (18)..(25): n stands for any nucleotide and can be optionally absent
ucagcuuucugaugaggnnnnnnnnccgaaaaaguucu

SEQ ID NO: 6280 - RNA, 38 nt, Artificial Sequence
  Description of Artificial Sequence:  Enzymatic Nucleic Acid
  misc_feature (18)..(25): n stands for any nucleotide and can be optionally absent
aucagcuucugaugaggnnnnnnnnccgaaaaaaguuc

SEQ ID NO: 6281 - RNA, 38 nt, Artificial Sequence
  Description of Artificial Sequence:  Enzymatic Nucleic Acid
  misc_feature (18)..(25): n stands for any nucleotide and can be optionally absent
ccaaucuccugaugaggnnnnnnnnccgaaaucagcuu

SEQ ID NO: 6282 - RNA, 38 nt, Artificial Sequence
  Description of Artificial Sequence:  Enzymatic Nucleic Acid
  misc_feature (18)..(25): n stands for any nucleotide and can be optionally absent
ugcacucccugaugaggnnnnnnnnccgaaaucucuau

SEQ ID NO: 6283 - RNA, 38 nt, Artificial Sequence
  Description of Artificial Sequence:  Enzymatic Nucleic Acid
  misc_feature (18)..(25): n stands for any nucleotide and can be optionally absent
ggcugugccugaugaggnnnnnnnnccgaaaccgguuu

SEQ ID NO: 6284 - RNA, 38 nt, Artificial Sequence
  Description of Artificial Sequence:  Enzymatic Nucleic Acid
  misc_feature (18)..(25): n stands for any nucleotide and can be optionally absent
ggcuggagcugaugaggnnnnnnnnccgaaaucugggc

SEQ ID NO: 6285 - RNA, 38 nt, Artificial Sequence
  Description of Artificial Sequence:  Enzymatic Nucleic Acid
  misc_feature (18)..(25): n stands for any nucleotide and can be optionally absent
aggcuggacugaugaggnnnnnnnnccgaaaaucuggg

SEQ ID NO: 6286 - RNA, 38 nt, Artificial Sequence
  Description of Artificial Sequence:  Enzymatic Nucleic Acid
  misc_feature (18)..(25): n stands for any nucleotide and can be optionally absent
ucaggcugcugaugaggnnnnnnnnccgaaagaaucug

SEQ ID NO: 6287 - RNA, 38 nt, Artificial Sequence
  Description of Artificial Sequence:  Enzymatic Nucleic Acid
  misc_feature (18)..(25): n stands for any nucleotide and can be optionally absent
caggaggacugaugaggnnnnnnnnccgaaagcucagu

SEQ ID NO: 6288 - RNA, 38 nt, Artificial Sequence
  Description of Artificial Sequence:  Enzymatic Nucleic Acid
  misc_feature (18)..(25): n stands for any nucleotide and can be optionally absent
aacaggagcugaugaggnnnnnnnnccgaaagagcuca

SEQ ID NO: 6289 - RNA, 38 nt, Artificial Sequence
  Description of Artificial Sequence:  Enzymatic Nucleic Acid
  misc_feature (18)..(25): n stands for any nucleotide and can be optionally absent
uuaaacagcugaugaggnnnnnnnnccgaaaggagagc

SEQ ID NO: 6290 - RNA, 38 nt, Artificial Sequence
  Description of Artificial Sequence:  Enzymatic Nucleic Acid
  misc_feature (18)..(25): n stands for any nucleotide and can be optionally absent
uccuuuuacugaugaggnnnnnnnnccgaaacaggagg

SEQ ID NO: 6291 - RNA, 38 nt, Artificial Sequence
  Description of Artificial Sequence:  Enzymatic Nucleic Acid
  misc_feature (18)..(25): n stands for any nucleotide and can be optionally absent
uuccuuuucugaugaggnnnnnnnnccgaaaacaggag

SEQ ID NO: 6292 - RNA, 38 nt, Artificial Sequence
  Description of Artificial Sequence:  Enzymatic Nucleic Acid
  misc_feature (18)..(25): n stands for any nucleotide and can be optionally absent
cuuccuuucugaugaggnnnnnnnnccgaaaaacagga

SEQ ID NO: 6293 - RNA, 38 nt, Artificial Sequence
  Description of Artificial Sequence:  Enzymatic Nucleic Acid
  misc_feature (18)..(25): n stands for any nucleotide and can be optionally absent
ggggugugcugaugaggnnnnnnnnccgaaaugcuucc

SEQ ID NO: 6294 - RNA, 38 nt, Artificial Sequence
  Description of Artificial Sequence:  Enzymatic Nucleic Acid
  misc_feature (18)..(25): n stands for any nucleotide and can be optionally absent
auguccggcugaugaggnnnnnnnnccgaaaguugggg

SEQ ID NO: 6295 - RNA, 38 nt, Artificial Sequence
  Description of Artificial Sequence:  Enzymatic Nucleic Acid
  misc_feature (18)..(25): n stands for any nucleotide and can be optionally absent
ucucaugucugaugaggnnnnnnnnccgaaauguccgg

SEQ ID NO: 6296 - RNA, 38 nt, Artificial Sequence
  Description of Artificial Sequence:  Enzymatic Nucleic Acid
  misc_feature (18)..(25): n stands for any nucleotide and can be optionally absent
ucugagcacugaugaggnnnnnnnnccgaaaccucuca

SEQ ID NO: 6297 - RNA, 38 nt, Artificial Sequence
  Description of Artificial Sequence:  Enzymatic Nucleic Acid
  misc_feature (18)..(25): n stands for any nucleotide and can be optionally absent
caaaaucucugaugaggnnnnnnnnccgaaagcagacc

SEQ ID NO: 6298 - RNA, 38 nt, Artificial Sequence
  Description of Artificial Sequence:  Enzymatic Nucleic Acid
  misc_feature (18)..(25): n stands for any nucleotide and can be optionally absent
cacuucaacugaugaggnnnnnnnnccgaaaucugagc

SEQ ID NO: 6299 - RNA, 38 nt, Artificial Sequence
  Description of Artificial Sequence:  Enzymatic Nucleic Acid
  misc_feature (18)..(25): n stands for any nucleotide and can be optionally absent
acacuucacugaugaggnnnnnnnnccgaaaaucugag

SEQ ID NO: 6300 - RNA, 38 nt, Artificial Sequence
  Description of Artificial Sequence:  Enzymatic Nucleic Acid
  misc_feature (18)..(25): n stands for any nucleotide and can be optionally absent
aacacuuccugaugaggnnnnnnnnccgaaaaaucuga

SEQ ID NO: 6301 - RNA, 38 nt, Artificial Sequence
  Description of Artificial Sequence:  Enzymatic Nucleic Acid
  misc_feature (18)..(25): n stands for any nucleotide and can be optionally absent
gaaagaaccugaugaggnnnnnnnnccgaaacacuuca

SEQ ID NO: 6302 - RNA, 38 nt, Artificial Sequence
  Description of Artificial Sequence:  Enzymatic Nucleic Acid
  misc_feature (18)..(25): n stands for any nucleotide and can be optionally absent
guggaaagcugaugaggnnnnnnnnccgaaacaacacu

SEQ ID NO: 6303 - RNA, 38 nt, Artificial Sequence
  Description of Artificial Sequence:  Enzymatic Nucleic Acid
  misc_feature (18)..(25): n stands for any nucleotide and can be optionally absent
gguggaaacugaugaggnnnnnnnnccgaaaacaacac

SEQ ID NO: 6304 - RNA, 38 nt, Artificial Sequence
  Description of Artificial Sequence:  Enzymatic Nucleic Acid
  misc_feature (18)..(25): n stands for any nucleotide and can be optionally absent
cugguggacugaugaggnnnnnnnnccgaaagaacaac

SEQ ID NO: 6305 - RNA, 38 nt, Artificial Sequence
  Description of Artificial Sequence:  Enzymatic Nucleic Acid
  misc_feature (18)..(25): n stands for any nucleotide and can be optionally absent
gcugguggcugaugaggnnnnnnnnccgaaaagaacaa

SEQ ID NO: 6306 - RNA, 38 nt, Artificial Sequence
  Description of Artificial Sequence:  Enzymatic Nucleic Acid
  misc_feature (18)..(25): n stands for any nucleotide and can be optionally absent
ugcuggugcugaugaggnnnnnnnnccgaaaaagaaca

SEQ ID NO: 6307 - RNA, 38 nt, Artificial Sequence
  Description of Artificial Sequence:  Enzymatic Nucleic Acid
  misc_feature (18)..(25): n stands for any nucleotide and can be optionally absent
aaugcggccugaugaggnnnnnnnnccgaaacuuccug

SEQ ID NO: 6308 - RNA, 38 nt, Artificial Sequence
  Description of Artificial Sequence:  Enzymatic Nucleic Acid
  misc_feature (18)..(25): n stands for any nucleotide and can be optionally absent
gaaaaucacugaugaggnnnnnnnnccgaaaugcggcu

SEQ ID NO: 6309 - RNA, 38 nt, Artificial Sequence
  Description of Artificial Sequence:  Enzymatic Nucleic Acid
  misc_feature (18)..(25): n stands for any nucleotide and can be optionally absent
ugaaaauccugaugaggnnnnnnnnccgaaaaugcggc

SEQ ID NO: 6310 - RNA, 38 nt, Artificial Sequence
  Description of Artificial Sequence:  Enzymatic Nucleic Acid
  misc_feature (18)..(25): n stands for any nucleotide and can be optionally absent
gaaaugaacugaugaggnnnnnnnnccgaaaucaaaug

SEQ ID NO: 6311 - RNA, 38 nt, Artificial Sequence
  Description of Artificial Sequence:  Enzymatic Nucleic Acid
  misc_feature (18)..(25): n stands for any nucleotide and can be optionally absent
cgaaaugacugaugaggnnnnnnnnccgaaaaucaaau

SEQ ID NO: 6312 - RNA, 38 nt, Artificial Sequence
  Description of Artificial Sequence:  Enzymatic Nucleic Acid
  misc_feature (18)..(25): n stands for any nucleotide and can be optionally absent
ucgaaaugcugaugaggnnnnnnnnccgaaaaaucaaa

SEQ ID NO: 6313 - RNA, 38 nt, Artificial Sequence
  Description of Artificial Sequence:  Enzymatic Nucleic Acid
  misc_feature (18)..(25): n stands for any nucleotide and can be optionally absent
gucgaaaucugaugaggnnnnnnnnccgaaaaaaucaa

SEQ ID NO: 6314 - RNA, 38 nt, Artificial Sequence
  Description of Artificial Sequence:  Enzymatic Nucleic Acid
  misc_feature (18)..(25): n stands for any nucleotide and can be optionally absent
guugucgacugaugaggnnnnnnnnccgaaaugaaaau

SEQ ID NO: 6315 - RNA, 38 nt, Artificial Sequence
  Description of Artificial Sequence:  Enzymatic Nucleic Acid
  misc_feature (18)..(25): n stands for any nucleotide and can be optionally absent
uguugucgcugaugaggnnnnnnnnccgaaaaugaaaa

SEQ ID NO: 6316 - RNA, 38 nt, Artificial Sequence
  Description of Artificial Sequence:  Enzymatic Nucleic Acid
  misc_feature (18)..(25): n stands for any nucleotide and can be optionally absent
cuguuguccugaugaggnnnnnnnnccgaaaaaugaaa

SEQ ID NO: 6317 - RNA, 38 nt, Artificial Sequence
  Description of Artificial Sequence:  Enzymatic Nucleic Acid
  misc_feature (18)..(25): n stands for any nucleotide and can be optionally absent
ugcagucccugaugaggnnnnnnnnccgaaagguccuu

SEQ ID NO: 6318 - RNA, 38 nt, Artificial Sequence
  Description of Artificial Sequence:  Enzymatic Nucleic Acid
  misc_feature (18)..(25): n stands for any nucleotide and can be optionally absent
gccuagaacugaugaggnnnnnnnnccgaaagcuggcu

SEQ ID NO: 6319 - RNA, 38 nt, Artificial Sequence
  Description of Artificial Sequence:  Enzymatic Nucleic Acid
  misc_feature (18)..(25): n stands for any nucleotide and can be optionally absent
aagccuagcugaugaggnnnnnnnnccgaaagagcugg

SEQ ID NO: 6320 - RNA, 38 nt, Artificial Sequence
  Description of Artificial Sequence:  Enzymatic Nucleic Acid
  misc_feature (18)..(25): n stands for any nucleotide and can be optionally absent
caagccuacugaugaggnnnnnnnnccgaaaagagcug

SEQ ID NO: 6321 - RNA, 38 nt, Artificial Sequence
  Description of Artificial Sequence:  Enzymatic Nucleic Acid
  misc_feature (18)..(25): n stands for any nucleotide and can be optionally absent
cacaagcccugaugaggnnnnnnnnccgaaagaagagc

SEQ ID NO: 6322 - RNA, 54 nt, Artificial Sequence
  Description of Artificial Sequence:  Enzymatic Nucleic Acid
  misc_feature (18)..(25): n stands for any nucleotide and can be optionally absent
cgacggccagaagcaccuaccagagaaacacacguugugguacauuaccuggua

SEQ ID NO: 6323 - RNA, 54 nt, Artificial Sequence
  Description of Artificial Sequence:  Enzymatic Nucleic Acid
  misc_feature (18)..(25): n stands for any nucleotide and can be optionally absent
cacagggcagaagccagcaccagagaaacacacguugugguacauuaccuggua

SEQ ID NO: 6324 - RNA, 54 nt, Artificial Sequence
  Description of Artificial Sequence:  Enzymatic Nucleic Acid
  misc_feature (18)..(25): n stands for any nucleotide and can be optionally absent
cccacagaagaagcccggaccagagaaacacacguugugguacauuaccuggua

SEQ ID NO: 6325 - RNA, 54 nt, Artificial Sequence
  Description of Artificial Sequence:  Enzymatic Nucleic Acid
  misc_feature (18)..(25): n stands for any nucleotide and can be optionally absent
ugagccugagaagaucaaaccagagaaacacacguugugguacauuaccuggua

SEQ ID NO: 6326 - RNA, 54 nt, Artificial Sequence
  Description of Artificial Sequence:  Enzymatic Nucleic Acid
  misc_feature (18)..(25): n stands for any nucleotide and can be optionally absent
gaggccaaagaaguuuccaccagagaaacacacguugugguacauuaccuggua

SEQ ID NO: 6327 - RNA, 54 nt, Artificial Sequence
  Description of Artificial Sequence:  Enzymatic Nucleic Acid
  misc_feature (18)..(25): n stands for any nucleotide and can be optionally absent
aaauggagagaaguaaucaccagagaaacacacguugugguacauuaccuggua

SEQ ID NO: 6328 - RNA, 54 nt, Artificial Sequence
  Description of Artificial Sequence:  Enzymatic Nucleic Acid
  misc_feature (18)..(25): n stands for any nucleotide and can be optionally absent
cuguuaccagaaggaacaaccagagaaacacacguugugguacauuaccuggua

SEQ ID NO: 6329 - RNA, 54 nt, Artificial Sequence
  Description of Artificial Sequence:  Enzymatic Nucleic Acid
  misc_feature (18)..(25): n stands for any nucleotide and can be optionally absent
acauaauaagaagguaacaccagagaaacacacguugugguacauuaccuggua

SEQ ID NO: 6330 - RNA, 54 nt, Artificial Sequence
  Description of Artificial Sequence:  Enzymatic Nucleic Acid
  misc_feature (18)..(25): n stands for any nucleotide and can be optionally absent
uuccaugaagaagacucaaccagagaaacacacguugugguacauuaccuggua

SEQ ID NO: 6331 - RNA, 54 nt, Artificial Sequence
  Description of Artificial Sequence:  Enzymatic Nucleic Acid
  misc_feature (18)..(25): n stands for any nucleotide and can be optionally absent
uuuucuccagaagauaguaccagagaaacacacguugugguacauuaccuggua

SEQ ID NO: 6332 - RNA, 54 nt, Artificial Sequence
  Description of Artificial Sequence:  Enzymatic Nucleic Acid
  misc_feature (18)..(25): n stands for any nucleotide and can be optionally absent
cacucccaagaaggguuuaccagagaaacacacguugugguacauuaccuggua

SEQ ID NO: 6333 - RNA, 54 nt, Artificial Sequence
  Description of Artificial Sequence:  Enzymatic Nucleic Acid
  misc_feature (18)..(25): n stands for any nucleotide and can be optionally absent
ucuuggucagaagcccacaccagagaaacacacguugugguacauuaccuggua

SEQ ID NO: 6334 - RNA, 54 nt, Artificial Sequence
  Description of Artificial Sequence:  Enzymatic Nucleic Acid
  misc_feature (18)..(25): n stands for any nucleotide and can be optionally absent
ccauaaucagaaguacauaccagagaaacacacguugugguacauuaccuggua

SEQ ID NO: 6335 - RNA, 54 nt, Artificial Sequence
  Description of Artificial Sequence:  Enzymatic Nucleic Acid
  misc_feature (18)..(25): n stands for any nucleotide and can be optionally absent
ucucaccaagaaggggugaccagagaaacacacguugugguacauuaccuggua

SEQ ID NO: 6336 - RNA, 54 nt, Artificial Sequence
  Description of Artificial Sequence:  Enzymatic Nucleic Acid
  misc_feature (18)..(25): n stands for any nucleotide and can be optionally absent
auggcauaagaaguacauaccagagaaacacacguugugguacauuaccuggua

SEQ ID NO: 6337 - RNA, 54 nt, Artificial Sequence
  Description of Artificial Sequence:  Enzymatic Nucleic Acid
  misc_feature (18)..(25): n stands for any nucleotide and can be optionally absent
cuuccuccagaagccaauaccagagaaacacacguugugguacauuaccuggua

SEQ ID NO: 6338 - RNA, 54 nt, Artificial Sequence
  Description of Artificial Sequence:  Enzymatic Nucleic Acid
  misc_feature (18)..(25): n stands for any nucleotide and can be optionally absent
gucacugaagaagcuuggaccagagaaacacacguugugguacauuaccuggua

SEQ ID NO: 6339 - RNA, 54 nt, Artificial Sequence
  Description of Artificial Sequence:  Enzymatic Nucleic Acid
  misc_feature (18)..(25): n stands for any nucleotide and can be optionally absent
uuguacaaagaagacacaaccagagaaacacacguugugguacauuaccuggua

SEQ ID NO: 6340 - RNA, 54 nt, Artificial Sequence
  Description of Artificial Sequence:  Enzymatic Nucleic Acid
  misc_feature (18)..(25): n stands for any nucleotide and can be optionally absent
gcucagugagaagcauguaccagagaaacacacguugugguacauuaccuggua

SEQ ID NO: 6341 - RNA, 54 nt, Artificial Sequence
  Description of Artificial Sequence:  Enzymatic Nucleic Acid
  misc_feature (18)..(25): n stands for any nucleotide and can be optionally absent
aaacguagagaagucugcaccagagaaacacacguugugguacauuaccuggua

SEQ ID NO: 6342 - RNA, 54 nt, Artificial Sequence
  Description of Artificial Sequence:  Enzymatic Nucleic Acid
  misc_feature (18)..(25): n stands for any nucleotide and can be optionally absent
uuggcagaagaagugggcaccagagaaacacacguugugguacauuaccuggua

SEQ ID NO: 6343 - RNA, 54 nt, Artificial Sequence
  Description of Artificial Sequence:  Enzymatic Nucleic Acid
  misc_feature (18)..(25): n stands for any nucleotide and can be optionally absent
uucuugcaagaaggugugaccagagaaacacacguugugguacauuaccuggua

SEQ ID NO: 6344 - RNA, 54 nt, Artificial Sequence
  Description of Artificial Sequence:  Enzymatic Nucleic Acid
  misc_feature (18)..(25): n stands for any nucleotide and can be optionally absent
uugagcaaagaagacauaaccagagaaacacacguugugguacauuaccuggua

SEQ ID NO: 6345 - RNA, 54 nt, Artificial Sequence
  Description of Artificial Sequence:  Enzymatic Nucleic Acid
  misc_feature (18)..(25): n stands for any nucleotide and can be optionally absent
ggacugugagaagccugaaccagagaaacacacguugugguacauuaccuggua

SEQ ID NO: 6346 - RNA, 54 nt, Artificial Sequence
  Description of Artificial Sequence:  Enzymatic Nucleic Acid
  misc_feature (18)..(25): n stands for any nucleotide and can be optionally absent
cgcucuagagaagugagcaccagagaaacacacguugugguacauuaccuggua

SEQ ID NO: 6347 - RNA, 54 nt, Artificial Sequence
  Description of Artificial Sequence:  Enzymatic Nucleic Acid
  misc_feature (18)..(25): n stands for any nucleotide and can be optionally absent
uacuugucagaagauucuaccagagaaacacacguugugguacauuaccuggua

SEQ ID NO: 6348 - RNA, 54 nt, Artificial Sequence
  Description of Artificial Sequence:  Enzymatic Nucleic Acid
  misc_feature (18)..(25): n stands for any nucleotide and can be optionally absent
accacaugagaaguggagaccagagaaacacacguugugguacauuaccuggua

SEQ ID NO: 6349 - RNA, 54 nt, Artificial Sequence
  Description of Artificial Sequence:  Enzymatic Nucleic Acid
  misc_feature (18)..(25): n stands for any nucleotide and can be optionally absent
gggaguucagaaggauccaccagagaaacacacguugugguacauuaccuggua

SEQ ID NO: 6350 - RNA, 54 nt, Artificial Sequence
  Description of Artificial Sequence:  Enzymatic Nucleic Acid
  misc_feature (18)..(25): n stands for any nucleotide and can be optionally absent
caucauaaagaagucguuaccagagaaacacacguugugguacauuaccuggua

SEQ ID NO: 6351 - RNA, 54 nt, Artificial Sequence
  Description of Artificial Sequence:  Enzymatic Nucleic Acid
  misc_feature (18)..(25): n stands for any nucleotide and can be optionally absent
cuagguucagaaggucucaccagagaaacacacguugugguacauuaccuggua

SEQ ID NO: 6352 - RNA, 54 nt, Artificial Sequence
  Description of Artificial Sequence:  Enzymatic Nucleic Acid
  misc_feature (18)..(25): n stands for any nucleotide and can be optionally absent
ccaaaggcagaagcuucaaccagagaaacacacguugugguacauuaccuggua

SEQ ID NO: 6353 - RNA, 54 nt, Artificial Sequence
  Description of Artificial Sequence:  Enzymatic Nucleic Acid
  misc_feature (18)..(25): n stands for any nucleotide and can be optionally absent
gguaagugagaagguuucaccagagaaacacacguugugguacauuaccuggua

SEQ ID NO: 6354 - RNA, 54 nt, Artificial Sequence
  Description of Artificial Sequence:  Enzymatic Nucleic Acid
  misc_feature (18)..(25): n stands for any nucleotide and can be optionally absent
aaauccagagaaggcugaaccagagaaacacacguugugguacauuaccuggua

SEQ ID NO: 6355 - RNA, 54 nt, Artificial Sequence
  Description of Artificial Sequence:  Enzymatic Nucleic Acid
  misc_feature (18)..(25): n stands for any nucleotide and can be optionally absent
gcuccaagagaaggaaguaccagagaaacacacguugugguacauuaccuggua

SEQ ID NO: 6356 - RNA, 54 nt, Artificial Sequence
  Description of Artificial Sequence:  Enzymatic Nucleic Acid
  misc_feature (18)..(25): n stands for any nucleotide and can be optionally absent
cacuuggaagaaguaacaaccagagaaacacacguugugguacauuaccuggua

SEQ ID NO: 6357 - RNA, 54 nt, Artificial Sequence
  Description of Artificial Sequence:  Enzymatic Nucleic Acid
  misc_feature (18)..(25): n stands for any nucleotide and can be optionally absent
cugacauaagaaggaucuaccagagaaacacacguugugguacauuaccuggua

SEQ ID NO: 6358 - RNA, 54 nt, Artificial Sequence
  Description of Artificial Sequence:  Enzymatic Nucleic Acid
  misc_feature (18)..(25): n stands for any nucleotide and can be optionally absent
guaguauaagaaggggccaccagagaaacacacguugugguacauuaccuggua

SEQ ID NO: 6359 - RNA, 54 nt, Artificial Sequence
  Description of Artificial Sequence:  Enzymatic Nucleic Acid
  misc_feature (18)..(25): n stands for any nucleotide and can be optionally absent
ccagcaugagaagguacaaccagagaaacacacguugugguacauuaccuggua

SEQ ID NO: 6360 - RNA, 54 nt, Artificial Sequence
  Description of Artificial Sequence:  Enzymatic Nucleic Acid
  misc_feature (18)..(25): n stands for any nucleotide and can be optionally absent
cccgugccagaaguccagaccagagaaacacacguugugguacauuaccuggua

SEQ ID NO: 6361 - RNA, 54 nt, Artificial Sequence
  Description of Artificial Sequence:  Enzymatic Nucleic Acid
  misc_feature (18)..(25): n stands for any nucleotide and can be optionally absent
gugagguaagaagagagaaccagagaaacacacguugugguacauuaccuggua

SEQ ID NO: 6362 - RNA, 54 nt, Artificial Sequence
  Description of Artificial Sequence:  Enzymatic Nucleic Acid
  misc_feature (18)..(25): n stands for any nucleotide and can be optionally absent
auacaggaagaaggugagaccagagaaacacacguugugguacauuaccuggua

SEQ ID NO: 6363 - RNA, 54 nt, Artificial Sequence
  Description of Artificial Sequence:  Enzymatic Nucleic Acid
  misc_feature (18)..(25): n stands for any nucleotide and can be optionally absent
cacucacaagaaggcucuaccagagaaacacacguugugguacauuaccuggua

SEQ ID NO: 6364 - RNA, 54 nt, Artificial Sequence
  Description of Artificial Sequence:  Enzymatic Nucleic Acid
  misc_feature (18)..(25): n stands for any nucleotide and can be optionally absent
ugguugucagaagggauuaccagagaaacacacguugugguacauuaccuggua

SEQ ID NO: 6365 - RNA, 54 nt, Artificial Sequence
  Description of Artificial Sequence:  Enzymatic Nucleic Acid
  misc_feature (18)..(25): n stands for any nucleotide and can be optionally absent
cacuguccagaagguuguaccagagaaacacacguugugguacauuaccuggua

SEQ ID NO: 6366 - RNA, 54 nt, Artificial Sequence
  Description of Artificial Sequence:  Enzymatic Nucleic Acid
  misc_feature (18)..(25): n stands for any nucleotide and can be optionally absent
gauauccgagaagguagcaccagagaaacacacguugugguacauuaccuggua

SEQ ID NO: 6367 - RNA, 54 nt, Artificial Sequence
  Description of Artificial Sequence:  Enzymatic Nucleic Acid
  misc_feature (18)..(25): n stands for any nucleotide and can be optionally absent
ucugugucagaagagugaaccagagaaacacacguugugguacauuaccuggua

SEQ ID NO: 6368 - RNA, 54 nt, Artificial Sequence
  Description of Artificial Sequence:  Enzymatic Nucleic Acid
  misc_feature (18)..(25): n stands for any nucleotide and can be optionally absent
agaaucugagaagugcuaaccagagaaacacacguugugguacauuaccuggua

SEQ ID NO: 6369 - RNA, 54 nt, Artificial Sequence
  Description of Artificial Sequence:  Enzymatic Nucleic Acid
  misc_feature (18)..(25): n stands for any nucleotide and can be optionally absent
gcuggagaagaagggcugaccagagaaacacacguugugguacauuaccuggua

SEQ ID NO: 6370 - RNA, 54 nt, Artificial Sequence
  Description of Artificial Sequence:  Enzymatic Nucleic Acid
  misc_feature (18)..(25): n stands for any nucleotide and can be optionally absent
ccgugucaagaaggagaaaccagagaaacacacguugugguacauuaccuggua

SEQ ID NO: 6371 - RNA, 54 nt, Artificial Sequence
  Description of Artificial Sequence:  Enzymatic Nucleic Acid
  misc_feature (18)..(25): n stands for any nucleotide and can be optionally absent
uccuuuuaagaaggaggaaccagagaaacacacguugugguacauuaccuggua

SEQ ID NO: 6372 - RNA, 54 nt, Artificial Sequence
  Description of Artificial Sequence:  Enzymatic Nucleic Acid
  misc_feature (18)..(25): n stands for any nucleotide and can be optionally absent
aaaaucugagaagaccucaccagagaaacacacguugugguacauuaccuggua

SEQ ID NO: 6373 - RNA, 54 nt, Artificial Sequence
  Description of Artificial Sequence:  Enzymatic Nucleic Acid
  misc_feature (18)..(25): n stands for any nucleotide and can be optionally absent
acuucaaaagaagagcagaccagagaaacacacguugugguacauuaccuggua

SEQ ID NO: 6374 - RNA, 54 nt, Artificial Sequence
  Description of Artificial Sequence:  Enzymatic Nucleic Acid
  misc_feature (18)..(25): n stands for any nucleotide and can be optionally absent
ucccugcaagaagaggucaccagagaaacacacguugugguacauuaccuggua

SEQ ID NO: 6375 - RNA, 54 nt, Artificial Sequence
  Description of Artificial Sequence:  Enzymatic Nucleic Acid
  misc_feature (18)..(25): n stands for any nucleotide and can be optionally absent
ccuagaagagaaggcuccaccagagaaacacacguugugguacauuaccuggua

SEQ ID NO: 6376 - RNA, 38 nt, Artificial Sequence
  Description of Artificial Sequence:  Enzymatic Nucleic Acid
  misc_feature (18)..(25): n stands for any nucleotide and can be optionally absent
ccguaccccugaugaggnnnnnnnnccgaaauucgccc

SEQ ID NO: 6377 - RNA, 38 nt, Artificial Sequence
  Description of Artificial Sequence:  Enzymatic Nucleic Acid
  misc_feature (18)..(25): n stands for any nucleotide and can be optionally absent
gggucccgcugaugaggnnnnnnnnccgaaacccaauu

SEQ ID NO: 6378 - RNA, 38 nt, Artificial Sequence
  Description of Artificial Sequence:  Enzymatic Nucleic Acid
  misc_feature (18)..(25): n stands for any nucleotide and can be optionally absent
ucgaccuccugaugaggnnnnnnnnccgaaaggggggu

SEQ ID NO: 6379 - RNA, 38 nt, Artificial Sequence
  Description of Artificial Sequence:  Enzymatic Nucleic Acid
  misc_feature (18)..(25): n stands for any nucleotide and can be optionally absent
auaccguccugaugaggnnnnnnnnccgaaaccucgag

SEQ ID NO: 6380 - RNA, 38 nt, Artificial Sequence
  Description of Artificial Sequence:  Enzymatic Nucleic Acid
  misc_feature (18)..(25): n stands for any nucleotide and can be optionally absent
cuuaucgacugaugaggnnnnnnnnccgaaaccgucga

SEQ ID NO: 6381 - RNA, 38 nt, Artificial Sequence
  Description of Artificial Sequence:  Enzymatic Nucleic Acid
  misc_feature (18)..(25): n stands for any nucleotide and can be optionally absent
agcuuauccugaugaggnnnnnnnnccgaaauaccguc

SEQ ID NO: 6382 - RNA, 38 nt, Artificial Sequence
  Description of Artificial Sequence:  Enzymatic Nucleic Acid
  misc_feature (18)..(25): n stands for any nucleotide and can be optionally absent
aucaagcucugaugaggnnnnnnnnccgaaaucgauac

SEQ ID NO: 6383 - RNA, 38 nt, Artificial Sequence
  Description of Artificial Sequence:  Enzymatic Nucleic Acid
  misc_feature (18)..(25): n stands for any nucleotide and can be optionally absent
ucgauauccugaugaggnnnnnnnnccgaaagcuuauc

SEQ ID NO: 6384 - RNA, 38 nt, Artificial Sequence
  Description of Artificial Sequence:  Enzymatic Nucleic Acid
  misc_feature (18)..(25): n stands for any nucleotide and can be optionally absent
gaauucgacugaugaggnnnnnnnnccgaaaucaagcu

SEQ ID NO: 6385 - RNA, 38 nt, Artificial Sequence
  Description of Artificial Sequence:  Enzymatic Nucleic Acid
  misc_feature (18)..(25): n stands for any nucleotide and can be optionally absent
ccgaauuccugaugaggnnnnnnnnccgaaauaucaag

SEQ ID NO: 6386 - RNA, 38 nt, Artificial Sequence
  Description of Artificial Sequence:  Enzymatic Nucleic Acid
  misc_feature (18)..(25): n stands for any nucleotide and can be optionally absent
ugggcccgcugaugaggnnnnnnnnccgaaauucgaua

SEQ ID NO: 6387 - RNA, 38 nt, Artificial Sequence
  Description of Artificial Sequence:  Enzymatic Nucleic Acid
  misc_feature (18)..(25): n stands for any nucleotide and can be optionally absent
cugggccccugaugaggnnnnnnnnccgaaaauucgau

SEQ ID NO: 6388 - RNA, 38 nt, Artificial Sequence
  Description of Artificial Sequence:  Enzymatic Nucleic Acid
  misc_feature (18)..(25): n stands for any nucleotide and can be optionally absent
ggcugcggcugaugaggnnnnnnnnccgaaacacaguc

SEQ ID NO: 6389 - RNA, 38 nt, Artificial Sequence
  Description of Artificial Sequence:  Enzymatic Nucleic Acid
  misc_feature (18)..(25): n stands for any nucleotide and can be optionally absent
agccaggucugaugaggnnnnnnnnccgaaaucccggc

SEQ ID NO: 6390 - RNA, 38 nt, Artificial Sequence
  Description of Artificial Sequence:  Enzymatic Nucleic Acid
  misc_feature (18)..(25): n stands for any nucleotide and can be optionally absent
guccgcggcugaugaggnnnnnnnnccgaaaucggguc

SEQ ID NO: 6391 - RNA, 38 nt, Artificial Sequence
  Description of Artificial Sequence:  Enzymatic Nucleic Acid
  misc_feature (18)..(25): n stands for any nucleotide and can be optionally absent
uguccgcgcugaugaggnnnnnnnnccgaaaaucgggu

SEQ ID NO: 6392 - RNA, 38 nt, Artificial Sequence
  Description of Artificial Sequence:  Enzymatic Nucleic Acid
  misc_feature (18)..(25): n stands for any nucleotide and can be optionally absent
accggggacugaugaggnnnnnnnnccgaaagcgcggg

SEQ ID NO: 6393 - RNA, 38 nt, Artificial Sequence
  Description of Artificial Sequence:  Enzymatic Nucleic Acid
  misc_feature (18)..(25): n stands for any nucleotide and can be optionally absent
agaccgggcugaugaggnnnnnnnnccgaaagagcgcg

SEQ ID NO: 6394 - RNA, 38 nt, Artificial Sequence
  Description of Artificial Sequence:  Enzymatic Nucleic Acid
  misc_feature (18)..(25): n stands for any nucleotide and can be optionally absent
cagcgcaacugaugaggnnnnnnnnccgaaaccgggga

SEQ ID NO: 6395 - RNA, 38 nt, Artificial Sequence
  Description of Artificial Sequence:  Enzymatic Nucleic Acid
  misc_feature (18)..(25): n stands for any nucleotide and can be optionally absent
cgcagcgccugaugaggnnnnnnnnccgaaagaccggg

SEQ ID NO: 6396 - RNA, 38 nt, Artificial Sequence
  Description of Artificial Sequence:  Enzymatic Nucleic Acid
  misc_feature (18)..(25): n stands for any nucleotide and can be optionally absent
agaggcggcugaugaggnnnnnnnnccgaaauggcccc

SEQ ID NO: 6397 - RNA, 38 nt, Artificial Sequence
  Description of Artificial Sequence:  Enzymatic Nucleic Acid
  misc_feature (18)..(25): n stands for any nucleotide and can be optionally absent
aagucacacugaugaggnnnnnnnnccgaaaggcggua

SEQ ID NO: 6398 - RNA, 38 nt, Artificial Sequence
  Description of Artificial Sequence:  Enzymatic Nucleic Acid
  misc_feature (18)..(25): n stands for any nucleotide and can be optionally absent
ccgcaaagcugaugaggnnnnnnnnccgaaagucacag

SEQ ID NO: 6399 - RNA, 38 nt, Artificial Sequence
  Description of Artificial Sequence:  Enzymatic Nucleic Acid
  misc_feature (18)..(25): n stands for any nucleotide and can be optionally absent
cccgcaaacugaugaggnnnnnnnnccgaaaagucaca

SEQ ID NO: 6400 - RNA, 38 nt, Artificial Sequence
  Description of Artificial Sequence:  Enzymatic Nucleic Acid
  misc_feature (18)..(25): n stands for any nucleotide and can be optionally absent
ggcccgcacugaugaggnnnnnnnnccgaaagaaguca

SEQ ID NO: 6401 - RNA, 38 nt, Artificial Sequence
  Description of Artificial Sequence:  Enzymatic Nucleic Acid
  misc_feature (18)..(25): n stands for any nucleotide and can be optionally absent
uggcccgccugaugaggnnnnnnnnccgaaaagaaguc

SEQ ID NO: 6402 - RNA, 38 nt, Artificial Sequence
  Description of Artificial Sequence:  Enzymatic Nucleic Acid
  misc_feature (18)..(25): n stands for any nucleotide and can be optionally absent
caggcacacugaugaggnnnnnnnnccgaaacuccuuc

SEQ ID NO: 6403 - RNA, 38 nt, Artificial Sequence
  Description of Artificial Sequence:  Enzymatic Nucleic Acid
  misc_feature (18)..(25): n stands for any nucleotide and can be optionally absent
ugggcacacugaugaggnnnnnnnnccgaaagcccagu

SEQ ID NO: 6404 - RNA, 38 nt, Artificial Sequence
  Description of Artificial Sequence:  Enzymatic Nucleic Acid
  misc_feature (18)..(25): n stands for any nucleotide and can be optionally absent
gcgacagccugaugaggnnnnnnnnccgaaagcagcgc

SEQ ID NO: 6405 - RNA, 38 nt, Artificial Sequence
  Description of Artificial Sequence:  Enzymatic Nucleic Acid
  misc_feature (18)..(25): n stands for any nucleotide and can be optionally absent
cacagagccugaugaggnnnnnnnnccgaaacagcuag

SEQ ID NO: 6406 - RNA, 38 nt, Artificial Sequence
  Description of Artificial Sequence:  Enzymatic Nucleic Acid
  misc_feature (18)..(25): n stands for any nucleotide and can be optionally absent
gaaccacacugaugaggnnnnnnnnccgaaagcgacag

SEQ ID NO: 6407 - RNA, 38 nt, Artificial Sequence
  Description of Artificial Sequence:  Enzymatic Nucleic Acid
  misc_feature (18)..(25): n stands for any nucleotide and can be optionally absent
ccacgcagcugaugaggnnnnnnnnccgaaaccacaga

SEQ ID NO: 6408 - RNA, 38 nt, Artificial Sequence
  Description of Artificial Sequence:  Enzymatic Nucleic Acid
  misc_feature (18)..(25): n stands for any nucleotide and can be optionally absent
uccacgcacugaugaggnnnnnnnnccgaaaaccacag

SEQ ID NO: 6409 - RNA, 38 nt, Artificial Sequence
  Description of Artificial Sequence:  Enzymatic Nucleic Acid
  misc_feature (18)..(25): n stands for any nucleotide and can be optionally absent
aacccacacugaugaggnnnnnnnnccgaaaggcggcu

SEQ ID NO: 6410 - RNA, 38 nt, Artificial Sequence
  Description of Artificial Sequence:  Enzymatic Nucleic Acid
  misc_feature (18)..(25): n stands for any nucleotide and can be optionally absent
gccagucacugaugaggnnnnnnnnccgaaacccacag

SEQ ID NO: 6411 - RNA, 38 nt, Artificial Sequence
  Description of Artificial Sequence:  Enzymatic Nucleic Acid
  misc_feature (18)..(25): n stands for any nucleotide and can be optionally absent
cgccaguccugaugaggnnnnnnnnccgaaaacccaca

SEQ ID NO: 6412 - RNA, 38 nt, Artificial Sequence
  Description of Artificial Sequence:  Enzymatic Nucleic Acid
  misc_feature (18)..(25): n stands for any nucleotide and can be optionally absent
auggagaacugaugaggnnnnnnnnccgaaaucgccag

SEQ ID NO: 6413 - RNA, 38 nt, Artificial Sequence
  Description of Artificial Sequence:  Enzymatic Nucleic Acid
  misc_feature (18)..(25): n stands for any nucleotide and can be optionally absent
gauggagacugaugaggnnnnnnnnccgaaaaucgcca

SEQ ID NO: 6414 - RNA, 38 nt, Artificial Sequence
  Description of Artificial Sequence:  Enzymatic Nucleic Acid
  misc_feature (18)..(25): n stands for any nucleotide and can be optionally absent
ggauggagcugaugaggnnnnnnnnccgaaaaaucgcc

SEQ ID NO: 6415 - RNA, 38 nt, Artificial Sequence
  Description of Artificial Sequence:  Enzymatic Nucleic Acid
  misc_feature (18)..(25): n stands for any nucleotide and can be optionally absent
gggauggacugaugaggnnnnnnnnccgaaaaaaucgc

SEQ ID NO: 6416 - RNA, 38 nt, Artificial Sequence
  Description of Artificial Sequence:  Enzymatic Nucleic Acid
  misc_feature (18)..(25): n stands for any nucleotide and can be optionally absent
gggggaugcugaugaggnnnnnnnnccgaaagaaaauc

SEQ ID NO: 6417 - RNA, 38 nt, Artificial Sequence
  Description of Artificial Sequence:  Enzymatic Nucleic Acid
  misc_feature (18)..(25): n stands for any nucleotide and can be optionally absent
cuugggggcugaugaggnnnnnnnnccgaaauggagaa

SEQ ID NO: 6418 - RNA, 38 nt, Artificial Sequence
  Description of Artificial Sequence:  Enzymatic Nucleic Acid
  misc_feature (18)..(25): n stands for any nucleotide and can be optionally absent
ugugugcucugaugaggnnnnnnnnccgaaagcuuggg

SEQ ID NO: 6419 - RNA, 38 nt, Artificial Sequence
  Description of Artificial Sequence:  Enzymatic Nucleic Acid
  misc_feature (18)..(25): n stands for any nucleotide and can be optionally absent
auugucagcugaugaggnnnnnnnnccgaaaugucuuu

SEQ ID NO: 6420 - RNA, 38 nt, Artificial Sequence
  Description of Artificial Sequence:  Enzymatic Nucleic Acid
  misc_feature (18)..(25): n stands for any nucleotide and can be optionally absent
uuugccaacugaugaggnnnnnnnnccgaaauugucag

SEQ ID NO: 6421 - RNA, 38 nt, Artificial Sequence
  Description of Artificial Sequence:  Enzymatic Nucleic Acid
  misc_feature (18)..(25): n stands for any nucleotide and can be optionally absent
auuugccacugaugaggnnnnnnnnccgaaaauuguca

SEQ ID NO: 6422 - RNA, 38 nt, Artificial Sequence
  Description of Artificial Sequence:  Enzymatic Nucleic Acid
  misc_feature (18)..(25): n stands for any nucleotide and can be optionally absent
uauuugcccugaugaggnnnnnnnnccgaaaaauuguc

SEQ ID NO: 6423 - RNA, 38 nt, Artificial Sequence
  Description of Artificial Sequence:  Enzymatic Nucleic Acid
  misc_feature (18)..(25): n stands for any nucleotide and can be optionally absent
aaggguugcugaugaggnnnnnnnnccgaaauuugcca

SEQ ID NO: 6424 - RNA, 38 nt, Artificial Sequence
  Description of Artificial Sequence:  Enzymatic Nucleic Acid
  misc_feature (18)..(25): n stands for any nucleotide and can be optionally absent
guaaucugcugaugaggnnnnnnnnccgaaaggguugu

SEQ ID NO: 6425 - RNA, 38 nt, Artificial Sequence
  Description of Artificial Sequence:  Enzymatic Nucleic Acid
  misc_feature (18)..(25): n stands for any nucleotide and can be optionally absent
aguaaucucugaugaggnnnnnnnnccgaaaaggguug

SEQ ID NO: 6426 - RNA, 38 nt, Artificial Sequence
  Description of Artificial Sequence:  Enzymatic Nucleic Acid
  misc_feature (18)..(25): n stands for any nucleotide and can be optionally absent
cugcaagucugaugaggnnnnnnnnccgaaaucugaag

SEQ ID NO: 6427 - RNA, 38 nt, Artificial Sequence
  Description of Artificial Sequence:  Enzymatic Nucleic Acid
  misc_feature (18)..(25): n stands for any nucleotide and can be optionally absent
ccugcaagcugaugaggnnnnnnnnccgaaaaucugaa

SEQ ID NO: 6428 - RNA, 38 nt, Artificial Sequence
  Description of Artificial Sequence:  Enzymatic Nucleic Acid
  misc_feature (18)..(25): n stands for any nucleotide and can be optionally absent
uccccugccugaugaggnnnnnnnnccgaaaguaaucu

SEQ ID NO: 6429 - RNA, 38 nt, Artificial Sequence
  Description of Artificial Sequence:  Enzymatic Nucleic Acid
  misc_feature (18)..(25): n stands for any nucleotide and can be optionally absent
aucacgcucugaugaggnnnnnnnnccgaaagcauugg

SEQ ID NO: 6430 - RNA, 38 nt, Artificial Sequence
  Description of Artificial Sequence:  Enzymatic Nucleic Acid
  misc_feature (18)..(25): n stands for any nucleotide and can be optionally absent
uuccucagcugaugaggnnnnnnnnccgaaaucacgcu

SEQ ID NO: 6431 - RNA, 38 nt, Artificial Sequence
  Description of Artificial Sequence:  Enzymatic Nucleic Acid
  misc_feature (18)..(25): n stands for any nucleotide and can be optionally absent
uuuccucacugaugaggnnnnnnnnccgaaaaucacgc

SEQ ID NO: 6432 - RNA, 38 nt, Artificial Sequence
  Description of Artificial Sequence:  Enzymatic Nucleic Acid
  misc_feature (18)..(25): n stands for any nucleotide and can be optionally absent
gucaccaacugaugaggnnnnnnnnccgaaacccuuuc

SEQ ID NO: 6433 - RNA, 38 nt, Artificial Sequence
  Description of Artificial Sequence:  Enzymatic Nucleic Acid
  misc_feature (18)..(25): n stands for any nucleotide and can be optionally absent
cagucacccugaugaggnnnnnnnnccgaaauacccuu

SEQ ID NO: 6434 - RNA, 38 nt, Artificial Sequence
  Description of Artificial Sequence:  Enzymatic Nucleic Acid
  misc_feature (18)..(25): n stands for any nucleotide and can be optionally absent
gcagaagacugaugaggnnnnnnnnccgaaacugucac

SEQ ID NO: 6435 - RNA, 38 nt, Artificial Sequence
  Description of Artificial Sequence:  Enzymatic Nucleic Acid
  misc_feature (18)..(25): n stands for any nucleotide and can be optionally absent
uugcagaacugaugaggnnnnnnnnccgaaauacuguc

SEQ ID NO: 6436 - RNA, 38 nt, Artificial Sequence
  Description of Artificial Sequence:  Enzymatic Nucleic Acid
  misc_feature (18)..(25): n stands for any nucleotide and can be optionally absent
uuuugcagcugaugaggnnnnnnnnccgaaagauacug

SEQ ID NO: 6437 - RNA, 38 nt, Artificial Sequence
  Description of Artificial Sequence:  Enzymatic Nucleic Acid
  misc_feature (18)..(25): n stands for any nucleotide and can be optionally absent
guuuugcacugaugaggnnnnnnnnccgaaaagauacu

SEQ ID NO: 6438 - RNA, 38 nt, Artificial Sequence
  Description of Artificial Sequence:  Enzymatic Nucleic Acid
  misc_feature (18)..(25): n stands for any nucleotide and can be optionally absent
ggaauggucugaugaggnnnnnnnnccgaaaguguuuu

SEQ ID NO: 6439 - RNA, 38 nt, Artificial Sequence
  Description of Artificial Sequence:  Enzymatic Nucleic Acid
  misc_feature (18)..(25): n stands for any nucleotide and can be optionally absent
acccugggcugaugaggnnnnnnnnccgaaauggugag

SEQ ID NO: 6440 - RNA, 38 nt, Artificial Sequence
  Description of Artificial Sequence:  Enzymatic Nucleic Acid
  misc_feature (18)..(25): n stands for any nucleotide and can be optionally absent
cacccuggcugaugaggnnnnnnnnccgaaaaugguga

SEQ ID NO: 6441 - RNA, 38 nt, Artificial Sequence
  Description of Artificial Sequence:  Enzymatic Nucleic Acid
  misc_feature (18)..(25): n stands for any nucleotide and can be optionally absent
ucauuucccugaugaggnnnnnnnnccgaaaccacccu

SEQ ID NO: 6442 - RNA, 38 nt, Artificial Sequence
  Description of Artificial Sequence:  Enzymatic Nucleic Acid
  misc_feature (18)..(25): n stands for any nucleotide and can be optionally absent
ggcuccagcugaugaggnnnnnnnnccgaaaucauuuc

SEQ ID NO: 6443 - RNA, 38 nt, Artificial Sequence
  Description of Artificial Sequence:  Enzymatic Nucleic Acid
  misc_feature (18)..(25): n stands for any nucleotide and can be optionally absent
cccgguaccugaugaggnnnnnnnnccgaaagcacuug

SEQ ID NO: 6444 - RNA, 38 nt, Artificial Sequence
  Description of Artificial Sequence:  Enzymatic Nucleic Acid
  misc_feature (18)..(25): n stands for any nucleotide and can be optionally absent
cgucccggcugaugaggnnnnnnnnccgaaacgagcac

SEQ ID NO: 6445 - RNA, 38 nt, Artificial Sequence
  Description of Artificial Sequence:  Enzymatic Nucleic Acid
  misc_feature (18)..(25): n stands for any nucleotide and can be optionally absent
gcuauguccugaugaggnnnnnnnnccgaaacgucccg

SEQ ID NO: 6446 - RNA, 38 nt, Artificial Sequence
  Description of Artificial Sequence:  Enzymatic Nucleic Acid
  misc_feature (18)..(25): n stands for any nucleotide and can be optionally absent
guggaggccugaugaggnnnnnnnnccgaaaugucgac

SEQ ID NO: 6447 - RNA, 38 nt, Artificial Sequence
  Description of Artificial Sequence:  Enzymatic Nucleic Acid
  misc_feature (18)..(25): n stands for any nucleotide and can be optionally absent
aaacagugcugaugaggnnnnnnnnccgaaaggcuaug

SEQ ID NO: 6448 - RNA, 38 nt, Artificial Sequence
  Description of Artificial Sequence:  Enzymatic Nucleic Acid
  misc_feature (18)..(25): n stands for any nucleotide and can be optionally absent
uagacauacugaugaggnnnnnnnnccgaaacagugga

SEQ ID NO: 6449 - RNA, 38 nt, Artificial Sequence
  Description of Artificial Sequence:  Enzymatic Nucleic Acid
  misc_feature (18)..(25): n stands for any nucleotide and can be optionally absent
auagacaucugaugaggnnnnnnnnccgaaaacagugg

SEQ ID NO: 6450 - RNA, 38 nt, Artificial Sequence
  Description of Artificial Sequence:  Enzymatic Nucleic Acid
  misc_feature (18)..(25): n stands for any nucleotide and can be optionally absent
cauagacacugaugaggnnnnnnnnccgaaaaacagug

SEQ ID NO: 6451 - RNA, 38 nt, Artificial Sequence
  Description of Artificial Sequence:  Enzymatic Nucleic Acid
  misc_feature (18)..(25): n stands for any nucleotide and can be optionally absent
cgaacauacugaugaggnnnnnnnnccgaaacauaaac

SEQ ID NO: 6452 - RNA, 38 nt, Artificial Sequence
  Description of Artificial Sequence:  Enzymatic Nucleic Acid
  misc_feature (18)..(25): n stands for any nucleotide and can be optionally absent
cucgaacacugaugaggnnnnnnnnccgaaagacauaa

SEQ ID NO: 6453 - RNA, 38 nt, Artificial Sequence
  Description of Artificial Sequence:  Enzymatic Nucleic Acid
  misc_feature (18)..(25): n stands for any nucleotide and can be optionally absent
uaaucucgcugaugaggnnnnnnnnccgaaacauagac

SEQ ID NO: 6454 - RNA, 38 nt, Artificial Sequence
  Description of Artificial Sequence:  Enzymatic Nucleic Acid
  misc_feature (18)..(25): n stands for any nucleotide and can be optionally absent
guaaucuccugaugaggnnnnnnnnccgaaaacauaga

SEQ ID NO: 6455 - RNA, 38 nt, Artificial Sequence
  Description of Artificial Sequence:  Enzymatic Nucleic Acid
  misc_feature (18)..(25): n stands for any nucleotide and can be optionally absent
ugaucugucugaugaggnnnnnnnnccgaaaucucgaa

SEQ ID NO: 6456 - RNA, 38 nt, Artificial Sequence
  Description of Artificial Sequence:  Enzymatic Nucleic Acid
  misc_feature (18)..(25): n stands for any nucleotide and can be optionally absent
gugaucugcugaugaggnnnnnnnnccgaaaaucucga

SEQ ID NO: 6457 - RNA, 38 nt, Artificial Sequence
  Description of Artificial Sequence:  Enzymatic Nucleic Acid
  misc_feature (18)..(25): n stands for any nucleotide and can be optionally absent
ugaauggucugaugaggnnnnnnnnccgaaaucuguaa

SEQ ID NO: 6458 - RNA, 38 nt, Artificial Sequence
  Description of Artificial Sequence:  Enzymatic Nucleic Acid
  misc_feature (18)..(25): n stands for any nucleotide and can be optionally absent
aggcgaugcugaugaggnnnnnnnnccgaaauggugau

SEQ ID NO: 6459 - RNA, 38 nt, Artificial Sequence
  Description of Artificial Sequence:  Enzymatic Nucleic Acid
  misc_feature (18)..(25): n stands for any nucleotide and can be optionally absent
gaggcgaucugaugaggnnnnnnnnccgaaaaugguga

SEQ ID NO: 6460 - RNA, 38 nt, Artificial Sequence
  Description of Artificial Sequence:  Enzymatic Nucleic Acid
  misc_feature (18)..(25): n stands for any nucleotide and can be optionally absent
acagaggccugaugaggnnnnnnnnccgaaaugaaugg

SEQ ID NO: 6461 - RNA, 38 nt, Artificial Sequence
  Description of Artificial Sequence:  Enzymatic Nucleic Acid
  misc_feature (18)..(25): n stands for any nucleotide and can be optionally absent
cacugacacugaugaggnnnnnnnnccgaaaggcgaug

SEQ ID NO: 6462 - RNA, 38 nt, Artificial Sequence
  Description of Artificial Sequence:  Enzymatic Nucleic Acid
  misc_feature (18)..(25): n stands for any nucleotide and can be optionally absent
uggucacucugaugaggnnnnnnnnccgaaacagaggc

SEQ ID NO: 6463 - RNA, 38 nt, Artificial Sequence
  Description of Artificial Sequence:  Enzymatic Nucleic Acid
  misc_feature (18)..(25): n stands for any nucleotide and can be optionally absent
auguacaccugaugaggnnnnnnnnccgaaaugccaug

SEQ ID NO: 6464 - RNA, 38 nt, Artificial Sequence
  Description of Artificial Sequence:  Enzymatic Nucleic Acid
  misc_feature (18)..(25): n stands for any nucleotide and can be optionally absent
cggugaugcugaugaggnnnnnnnnccgaaacacgaug

SEQ ID NO: 6465 - RNA, 38 nt, Artificial Sequence
  Description of Artificial Sequence:  Enzymatic Nucleic Acid
  misc_feature (18)..(25): n stands for any nucleotide and can be optionally absent
uucucggucugaugaggnnnnnnnnccgaaauguacac

SEQ ID NO: 6466 - RNA, 38 nt, Artificial Sequence
  Description of Artificial Sequence:  Enzymatic Nucleic Acid
  misc_feature (18)..(25): n stands for any nucleotide and can be optionally absent
cggcagggcugaugaggnnnnnnnnccgaaaucaccac

SEQ ID NO: 6467 - RNA, 38 nt, Artificial Sequence
  Description of Artificial Sequence:  Enzymatic Nucleic Acid
  misc_feature (18)..(25): n stands for any nucleotide and can be optionally absent
uugaaauccugaugaggnnnnnnnnccgaaacccucgg

SEQ ID NO: 6468 - RNA, 38 nt, Artificial Sequence
  Description of Artificial Sequence:  Enzymatic Nucleic Acid
  misc_feature (18)..(25): n stands for any nucleotide and can be optionally absent
agguuugacugaugaggnnnnnnnnccgaaaucgaccc

SEQ ID NO: 6469 - RNA, 38 nt, Artificial Sequence
  Description of Artificial Sequence:  Enzymatic Nucleic Acid
  misc_feature (18)..(25): n stands for any nucleotide and can be optionally absent
gagguuugcugaugaggnnnnnnnnccgaaaaucgacc

SEQ ID NO: 6470 - RNA, 38 nt, Artificial Sequence
  Description of Artificial Sequence:  Enzymatic Nucleic Acid
  misc_feature (18)..(25): n stands for any nucleotide and can be optionally absent
ugagguuucugaugaggnnnnnnnnccgaaaaaucgac

SEQ ID NO: 6471 - RNA, 38 nt, Artificial Sequence
  Description of Artificial Sequence:  Enzymatic Nucleic Acid
  misc_feature (18)..(25): n stands for any nucleotide and can be optionally absent
gacacauucugaugaggnnnnnnnnccgaaagguuuga

SEQ ID NO: 6472 - RNA, 38 nt, Artificial Sequence
  Description of Artificial Sequence:  Enzymatic Nucleic Acid
  misc_feature (18)..(25): n stands for any nucleotide and can be optionally absent
cgcaaagacugaugaggnnnnnnnnccgaaacacauug

SEQ ID NO: 6473 - RNA, 38 nt, Artificial Sequence
  Description of Artificial Sequence:  Enzymatic Nucleic Acid
  misc_feature (18)..(25): n stands for any nucleotide and can be optionally absent
agcgcaaacugaugaggnnnnnnnnccgaaagacacau

SEQ ID NO: 6474 - RNA, 38 nt, Artificial Sequence
  Description of Artificial Sequence:  Enzymatic Nucleic Acid
  misc_feature (18)..(25): n stands for any nucleotide and can be optionally absent
cuagcgcacugaugaggnnnnnnnnccgaaagagacac

SEQ ID NO: 6475 - RNA, 38 nt, Artificial Sequence
  Description of Artificial Sequence:  Enzymatic Nucleic Acid
  misc_feature (18)..(25): n stands for any nucleotide and can be optionally absent
ccuagcgccugaugaggnnnnnnnnccgaaaagagaca

SEQ ID NO: 6476 - RNA, 38 nt, Artificial Sequence
  Description of Artificial Sequence:  Enzymatic Nucleic Acid
  misc_feature (18)..(25): n stands for any nucleotide and can be optionally absent
uggauacccugaugaggnnnnnnnnccgaaagcgcaaa

SEQ ID NO: 6477 - RNA, 38 nt, Artificial Sequence
  Description of Artificial Sequence:  Enzymatic Nucleic Acid
  misc_feature (18)..(25): n stands for any nucleotide and can be optionally absent
uuucuggacugaugaggnnnnnnnnccgaaaccuagcg

SEQ ID NO: 6478 - RNA, 38 nt, Artificial Sequence
  Description of Artificial Sequence:  Enzymatic Nucleic Acid
  misc_feature (18)..(25): n stands for any nucleotide and can be optionally absent
cuuuucugcugaugaggnnnnnnnnccgaaauaccuag

SEQ ID NO: 6479 - RNA, 38 nt, Artificial Sequence
  Description of Artificial Sequence:  Enzymatic Nucleic Acid
  misc_feature (18)..(25): n stands for any nucleotide and can be optionally absent
ccggaacacugaugaggnnnnnnnnccgaaaucucuuu

SEQ ID NO: 6480 - RNA, 38 nt, Artificial Sequence
  Description of Artificial Sequence:  Enzymatic Nucleic Acid
  misc_feature (18)..(25): n stands for any nucleotide and can be optionally absent
uccggaaccugaugaggnnnnnnnnccgaaaaucucuu

SEQ ID NO: 6481 - RNA, 38 nt, Artificial Sequence
  Description of Artificial Sequence:  Enzymatic Nucleic Acid
  misc_feature (18)..(25): n stands for any nucleotide and can be optionally absent
ccauccggcugaugaggnnnnnnnnccgaaacaaaucu

SEQ ID NO: 6482 - RNA, 38 nt, Artificial Sequence
  Description of Artificial Sequence:  Enzymatic Nucleic Acid
  misc_feature (18)..(25): n stands for any nucleotide and can be optionally absent
uccauccgcugaugaggnnnnnnnnccgaaaacaaauc

SEQ ID NO: 6483 - RNA, 38 nt, Artificial Sequence
  Description of Artificial Sequence:  Enzymatic Nucleic Acid
  misc_feature (18)..(25): n stands for any nucleotide and can be optionally absent
guaaagcccugaugaggnnnnnnnnccgaaaucucgcu

SEQ ID NO: 6484 - RNA, 38 nt, Artificial Sequence
  Description of Artificial Sequence:  Enzymatic Nucleic Acid
  misc_feature (18)..(25): n stands for any nucleotide and can be optionally absent
ggagaguacugaugaggnnnnnnnnccgaaagccuauc

SEQ ID NO: 6485 - RNA, 38 nt, Artificial Sequence
  Description of Artificial Sequence:  Enzymatic Nucleic Acid
  misc_feature (18)..(25): n stands for any nucleotide and can be optionally absent
gggagagucugaugaggnnnnnnnnccgaaaagccuau

SEQ ID NO: 6486 - RNA, 38 nt, Artificial Sequence
  Description of Artificial Sequence:  Enzymatic Nucleic Acid
  misc_feature (18)..(25): n stands for any nucleotide and can be optionally absent
ggggagagcugaugaggnnnnnnnnccgaaaaagccua

SEQ ID NO: 6487 - RNA, 38 nt, Artificial Sequence
  Description of Artificial Sequence:  Enzymatic Nucleic Acid
  misc_feature (18)..(25): n stands for any nucleotide and can be optionally absent
acuggggacugaugaggnnnnnnnnccgaaaguaaagc

SEQ ID NO: 6488 - RNA, 38 nt, Artificial Sequence
  Description of Artificial Sequence:  Enzymatic Nucleic Acid
  misc_feature (18)..(25): n stands for any nucleotide and can be optionally absent
uaacugggcugaugaggnnnnnnnnccgaaagaguaaa

SEQ ID NO: 6489 - RNA, 38 nt, Artificial Sequence
  Description of Artificial Sequence:  Enzymatic Nucleic Acid
  misc_feature (18)..(25): n stands for any nucleotide and can be optionally absent
gaucaugucugaugaggnnnnnnnnccgaaacugggga

SEQ ID NO: 6490 - RNA, 38 nt, Artificial Sequence
  Description of Artificial Sequence:  Enzymatic Nucleic Acid
  misc_feature (18)..(25): n stands for any nucleotide and can be optionally absent
ugaucaugcugaugaggnnnnnnnnccgaaaacugggg

SEQ ID NO: 6491 - RNA, 38 nt, Artificial Sequence
  Description of Artificial Sequence:  Enzymatic Nucleic Acid
  misc_feature (18)..(25): n stands for any nucleotide and can be optionally absent
ugccggcacugaugaggnnnnnnnnccgaaagcugauc

SEQ ID NO: 6492 - RNA, 38 nt, Artificial Sequence
  Description of Artificial Sequence:  Enzymatic Nucleic Acid
  misc_feature (18)..(25): n stands for any nucleotide and can be optionally absent
ccucacagcugaugaggnnnnnnnnccgaaagaccaug

SEQ ID NO: 6493 - RNA, 38 nt, Artificial Sequence
  Description of Artificial Sequence:  Enzymatic Nucleic Acid
  misc_feature (18)..(25): n stands for any nucleotide and can be optionally absent
gccucacacugaugaggnnnnnnnnccgaaaagaccau

SEQ ID NO: 6494 - RNA, 38 nt, Artificial Sequence
  Description of Artificial Sequence:  Enzymatic Nucleic Acid
  misc_feature (18)..(25): n stands for any nucleotide and can be optionally absent
ucaucauucugaugaggnnnnnnnnccgaaaucuuugc

SEQ ID NO: 6495 - RNA, 38 nt, Artificial Sequence
  Description of Artificial Sequence:  Enzymatic Nucleic Acid
  misc_feature (18)..(25): n stands for any nucleotide and can be optionally absent
uagacugacugaugaggnnnnnnnnccgaaagguuuca

SEQ ID NO: 6496 - RNA, 38 nt, Artificial Sequence
  Description of Artificial Sequence:  Enzymatic Nucleic Acid
  misc_feature (18)..(25): n stands for any nucleotide and can be optionally absent
gauagacucugaugaggnnnnnnnnccgaaauagguuu

SEQ ID NO: 6497 - RNA, 38 nt, Artificial Sequence
  Description of Artificial Sequence:  Enzymatic Nucleic Acid
  misc_feature (18)..(25): n stands for any nucleotide and can be optionally absent
acaugauacugaugaggnnnnnnnnccgaaacugauag

SEQ ID NO: 6498 - RNA, 38 nt, Artificial Sequence
  Description of Artificial Sequence:  Enzymatic Nucleic Acid
  misc_feature (18)..(25): n stands for any nucleotide and can be optionally absent
guacaugacugaugaggnnnnnnnnccgaaagacugau

SEQ ID NO: 6499 - RNA, 38 nt, Artificial Sequence
  Description of Artificial Sequence:  Enzymatic Nucleic Acid
  misc_feature (18)..(25): n stands for any nucleotide and can be optionally absent
caacuaugcugaugaggnnnnnnnnccgaaacaugaua

SEQ ID NO: 6500 - RNA, 38 nt, Artificial Sequence
  Description of Artificial Sequence:  Enzymatic Nucleic Acid
  misc_feature (18)..(25): n stands for any nucleotide and can be optionally absent
accacaaccugaugaggnnnnnnnnccgaaauguacau

SEQ ID NO: 6501 - RNA, 38 nt, Artificial Sequence
  Description of Artificial Sequence:  Enzymatic Nucleic Acid
  misc_feature (18)..(25): n stands for any nucleotide and can be optionally absent
acaaccaccugaugaggnnnnnnnnccgaaacuaugua

SEQ ID NO: 6502 - RNA, 38 nt, Artificial Sequence
  Description of Artificial Sequence:  Enzymatic Nucleic Acid
  misc_feature (18)..(25): n stands for any nucleotide and can be optionally absent
uauccuaccugaugaggnnnnnnnnccgaaaccacaac

SEQ ID NO: 6503 - RNA, 38 nt, Artificial Sequence
  Description of Artificial Sequence:  Enzymatic Nucleic Acid
  misc_feature (18)..(25): n stands for any nucleotide and can be optionally absent
cuauaucccugaugaggnnnnnnnnccgaaacaaccac

SEQ ID NO: 6504 - RNA, 38 nt, Artificial Sequence
  Description of Artificial Sequence:  Enzymatic Nucleic Acid
  misc_feature (18)..(25): n stands for any nucleotide and can be optionally absent
aaauccuacugaugaggnnnnnnnnccgaaauccuaca

SEQ ID NO: 6505 - RNA, 38 nt, Artificial Sequence
  Description of Artificial Sequence:  Enzymatic Nucleic Acid
  misc_feature (18)..(25): n stands for any nucleotide and can be optionally absent
auaaaucccugaugaggnnnnnnnnccgaaauauccua

SEQ ID NO: 6506 - RNA, 38 nt, Artificial Sequence
  Description of Artificial Sequence:  Enzymatic Nucleic Acid
  misc_feature (18)..(25): n stands for any nucleotide and can be optionally absent
ucacaucacugaugaggnnnnnnnnccgaaaaauccua

SEQ ID NO: 6507 - RNA, 38 nt, Artificial Sequence
  Description of Artificial Sequence:  Enzymatic Nucleic Acid
  misc_feature (18)..(25): n stands for any nucleotide and can be optionally absent
gggcucagcugaugaggnnnnnnnnccgaaaucacauc

SEQ ID NO: 6508 - RNA, 38 nt, Artificial Sequence
  Description of Artificial Sequence:  Enzymatic Nucleic Acid
  misc_feature (18)..(25): n stands for any nucleotide and can be optionally absent
ggggcucacugaugaggnnnnnnnnccgaaaaucacau

SEQ ID NO: 6509 - RNA, 38 nt, Artificial Sequence
  Description of Artificial Sequence:  Enzymatic Nucleic Acid
  misc_feature (18)..(25): n stands for any nucleotide and can be optionally absent
gauagcuccugaugaggnnnnnnnnccgaaauuucaug

SEQ ID NO: 6510 - RNA, 38 nt, Artificial Sequence
  Description of Artificial Sequence:  Enzymatic Nucleic Acid
  misc_feature (18)..(25): n stands for any nucleotide and can be optionally absent
ccggcagacugaugaggnnnnnnnnccgaaagcucaau

SEQ ID NO: 6511 - RNA, 38 nt, Artificial Sequence
  Description of Artificial Sequence:  Enzymatic Nucleic Acid
  misc_feature (18)..(25): n stands for any nucleotide and can be optionally absent
cuccggcacugaugaggnnnnnnnnccgaaauagcuca

SEQ ID NO: 6512 - RNA, 38 nt, Artificial Sequence
  Description of Artificial Sequence:  Enzymatic Nucleic Acid
  misc_feature (18)..(25): n stands for any nucleotide and can be optionally absent
uuuaagaccugaugaggnnnnnnnnccgaaaguuuuuc

SEQ ID NO: 6513 - RNA, 38 nt, Artificial Sequence
  Description of Artificial Sequence:  Enzymatic Nucleic Acid
  misc_feature (18)..(25): n stands for any nucleotide and can be optionally absent
caauuuaacugaugaggnnnnnnnnccgaaacaaguuu

SEQ ID NO: 6514 - RNA, 38 nt, Artificial Sequence
  Description of Artificial Sequence:  Enzymatic Nucleic Acid
  misc_feature (18)..(25): n stands for any nucleotide and can be optionally absent
uacaauuucugaugaggnnnnnnnnccgaaagacaagu

SEQ ID NO: 6515 - RNA, 38 nt, Artificial Sequence
  Description of Artificial Sequence:  Enzymatic Nucleic Acid
  misc_feature (18)..(25): n stands for any nucleotide and can be optionally absent
cgcuguaccugaugaggnnnnnnnnccgaaauuuaaga

SEQ ID NO: 6516 - RNA, 38 nt, Artificial Sequence
  Description of Artificial Sequence:  Enzymatic Nucleic Acid
  misc_feature (18)..(25): n stands for any nucleotide and can be optionally absent
ucucgcugcugaugaggnnnnnnnnccgaaacaauuua

SEQ ID NO: 6517 - RNA, 38 nt, Artificial Sequence
  Description of Artificial Sequence:  Enzymatic Nucleic Acid
  misc_feature (18)..(25): n stands for any nucleotide and can be optionally absent
cccacauucugaugaggnnnnnnnnccgaaagcucugu

SEQ ID NO: 6518 - RNA, 38 nt, Artificial Sequence
  Description of Artificial Sequence:  Enzymatic Nucleic Acid
  misc_feature (18)..(25): n stands for any nucleotide and can be optionally absent
gugaaauccugaugaggnnnnnnnnccgaaagccccac

SEQ ID NO: 6519 - RNA, 38 nt, Artificial Sequence
  Description of Artificial Sequence:  Enzymatic Nucleic Acid
  misc_feature (18)..(25): n stands for any nucleotide and can be optionally absent
ccaggugacugaugaggnnnnnnnnccgaaaucaagcc

SEQ ID NO: 6520 - RNA, 38 nt, Artificial Sequence
  Description of Artificial Sequence:  Enzymatic Nucleic Acid
  misc_feature (18)..(25): n stands for any nucleotide and can be optionally absent
gccaggugcugaugaggnnnnnnnnccgaaaaucaagc

SEQ ID NO: 6521 - RNA, 38 nt, Artificial Sequence
  Description of Artificial Sequence:  Enzymatic Nucleic Acid
  misc_feature (18)..(25): n stands for any nucleotide and can be optionally absent
ugccaggucugaugaggnnnnnnnnccgaaaaaucaag

SEQ ID NO: 6522 - RNA, 38 nt, Artificial Sequence
  Description of Artificial Sequence:  Enzymatic Nucleic Acid
  misc_feature (18)..(25): n stands for any nucleotide and can be optionally absent
aagguggacugaugaggnnnnnnnnccgaaagugccag

SEQ ID NO: 6523 - RNA, 38 nt, Artificial Sequence
  Description of Artificial Sequence:  Enzymatic Nucleic Acid
  misc_feature (18)..(25): n stands for any nucleotide and can be optionally absent
ugaaggugcugaugaggnnnnnnnnccgaaagagugcc

SEQ ID NO: 6524 - RNA, 38 nt, Artificial Sequence
  Description of Artificial Sequence:  Enzymatic Nucleic Acid
  misc_feature (18)..(25): n stands for any nucleotide and can be optionally absent
agacuuugcugaugaggnnnnnnnnccgaaagguggag

SEQ ID NO: 6525 - RNA, 38 nt, Artificial Sequence
  Description of Artificial Sequence:  Enzymatic Nucleic Acid
  misc_feature (18)..(25): n stands for any nucleotide and can be optionally absent
gagacuuucugaugaggnnnnnnnnccgaaaaggugga

SEQ ID NO: 6526 - RNA, 38 nt, Artificial Sequence
  Description of Artificial Sequence:  Enzymatic Nucleic Acid
  misc_feature (18)..(25): n stands for any nucleotide and can be optionally absent
uaugaugacugaugaggnnnnnnnnccgaaacuuugaa

SEQ ID NO: 6527 - RNA, 38 nt, Artificial Sequence
  Description of Artificial Sequence:  Enzymatic Nucleic Acid
  misc_feature (18)..(25): n stands for any nucleotide and can be optionally absent
cuuaugaucugaugaggnnnnnnnnccgaaagacuuug

SEQ ID NO: 6528 - RNA, 38 nt, Artificial Sequence
  Description of Artificial Sequence:  Enzymatic Nucleic Acid
  misc_feature (18)..(25): n stands for any nucleotide and can be optionally absent
cuucuuaucugaugaggnnnnnnnnccgaaaugagacu

SEQ ID NO: 6529 - RNA, 38 nt, Artificial Sequence
  Description of Artificial Sequence:  Enzymatic Nucleic Acid
  misc_feature (18)..(25): n stands for any nucleotide and can be optionally absent
aaucuucucugaugaggnnnnnnnnccgaaaugaugag

SEQ ID NO: 6530 - RNA, 38 nt, Artificial Sequence
  Description of Artificial Sequence:  Enzymatic Nucleic Acid
  misc_feature (18)..(25): n stands for any nucleotide and can be optionally absent
cgguuuaccugaugaggnnnnnnnnccgaaaucuucuu

SEQ ID NO: 6531 - RNA, 38 nt, Artificial Sequence
  Description of Artificial Sequence:  Enzymatic Nucleic Acid
  misc_feature (18)..(25): n stands for any nucleotide and can be optionally absent
ucccgguucugaugaggnnnnnnnnccgaaacaaucuu

SEQ ID NO: 6532 - RNA, 38 nt, Artificial Sequence
  Description of Artificial Sequence:  Enzymatic Nucleic Acid
  misc_feature (18)..(25): n stands for any nucleotide and can be optionally absent
ucccaggacugaugaggnnnnnnnnccgaaaggguuuc

SEQ ID NO: 6533 - RNA, 38 nt, Artificial Sequence
  Description of Artificial Sequence:  Enzymatic Nucleic Acid
  misc_feature (18)..(25): n stands for any nucleotide and can be optionally absent
gucccaggcugaugaggnnnnnnnnccgaaaaggguuu

SEQ ID NO: 6534 - RNA, 38 nt, Artificial Sequence
  Description of Artificial Sequence:  Enzymatic Nucleic Acid
  misc_feature (18)..(25): n stands for any nucleotide and can be optionally absent
agucccagcugaugaggnnnnnnnnccgaaaaaggguu

SEQ ID NO: 6535 - RNA, 38 nt, Artificial Sequence
  Description of Artificial Sequence:  Enzymatic Nucleic Acid
  misc_feature (18)..(25): n stands for any nucleotide and can be optionally absent
ugcucaaacugaugaggnnnnnnnnccgaaacaucuuc

SEQ ID NO: 6536 - RNA, 38 nt, Artificial Sequence
  Description of Artificial Sequence:  Enzymatic Nucleic Acid
  misc_feature (18)..(25): n stands for any nucleotide and can be optionally absent
gugcucaacugaugaggnnnnnnnnccgaaaacaucuu

SEQ ID NO: 6537 - RNA, 38 nt, Artificial Sequence
  Description of Artificial Sequence:  Enzymatic Nucleic Acid
  misc_feature (18)..(25): n stands for any nucleotide and can be optionally absent
ggugcucacugaugaggnnnnnnnnccgaaaaacaucu

SEQ ID NO: 6538 - RNA, 38 nt, Artificial Sequence
  Description of Artificial Sequence:  Enzymatic Nucleic Acid
  misc_feature (18)..(25): n stands for any nucleotide and can be optionally absent
aggugcuccugaugaggnnnnnnnnccgaaaaaacauc

SEQ ID NO: 6539 - RNA, 38 nt, Artificial Sequence
  Description of Artificial Sequence:  Enzymatic Nucleic Acid
  misc_feature (18)..(25): n stands for any nucleotide and can be optionally absent
cuauuguccugaugaggnnnnnnnnccgaaaggugcuc

SEQ ID NO: 6540 - RNA, 38 nt, Artificial Sequence
  Description of Artificial Sequence:  Enzymatic Nucleic Acid
  misc_feature (18)..(25): n stands for any nucleotide and can be optionally absent
acacuuuccugaugaggnnnnnnnnccgaaauugucaa

SEQ ID NO: 6541 - RNA, 38 nt, Artificial Sequence
  Description of Artificial Sequence:  Enzymatic Nucleic Acid
  misc_feature (18)..(25): n stands for any nucleotide and can be optionally absent
cacaggugcugaugaggnnnnnnnnccgaaauuccccu

SEQ ID NO: 6542 - RNA, 38 nt, Artificial Sequence
  Description of Artificial Sequence:  Enzymatic Nucleic Acid
  misc_feature (18)..(25): n stands for any nucleotide and can be optionally absent
cuggacgccugaugaggnnnnnnnnccgaaacacaggu

SEQ ID NO: 6543 - RNA, 38 nt, Artificial Sequence
  Description of Artificial Sequence:  Enzymatic Nucleic Acid
  misc_feature (18)..(25): n stands for any nucleotide and can be optionally absent
guccacugcugaugaggnnnnnnnnccgaaacgcuaca

SEQ ID NO: 6544 - RNA, 38 nt, Artificial Sequence
  Description of Artificial Sequence:  Enzymatic Nucleic Acid
  misc_feature (18)..(25): n stands for any nucleotide and can be optionally absent
uuucucuucugaugaggnnnnnnnnccgaaaucauccg

SEQ ID NO: 6545 - RNA, 38 nt, Artificial Sequence
  Description of Artificial Sequence:  Enzymatic Nucleic Acid
  misc_feature (18)..(25): n stands for any nucleotide and can be optionally absent
aaauguuccugaugaggnnnnnnnnccgaaauuucucu

SEQ ID NO: 6546 - RNA, 38 nt, Artificial Sequence
  Description of Artificial Sequence:  Enzymatic Nucleic Acid
  misc_feature (18)..(25): n stands for any nucleotide and can be optionally absent
cucggacacugaugaggnnnnnnnnccgaaauguucua

SEQ ID NO: 6547 - RNA, 38 nt, Artificial Sequence
  Description of Artificial Sequence:  Enzymatic Nucleic Acid
  misc_feature (18)..(25): n stands for any nucleotide and can be optionally absent
acucggaccugaugaggnnnnnnnnccgaaaauguucu

SEQ ID NO: 6548 - RNA, 38 nt, Artificial Sequence
  Description of Artificial Sequence:  Enzymatic Nucleic Acid
  misc_feature (18)..(25): n stands for any nucleotide and can be optionally absent
ugaacucgcugaugaggnnnnnnnnccgaaacaaaugu

SEQ ID NO: 6549 - RNA, 38 nt, Artificial Sequence
  Description of Artificial Sequence:  Enzymatic Nucleic Acid
  misc_feature (18)..(25): n stands for any nucleotide and can be optionally absent
uuugugugcugaugaggnnnnnnnnccgaaacucggac

SEQ ID NO: 6550 - RNA, 38 nt, Artificial Sequence
  Description of Artificial Sequence:  Enzymatic Nucleic Acid
  misc_feature (18)..(25): n stands for any nucleotide and can be optionally absent
cuuugugucugaugaggnnnnnnnnccgaaaacucgga

SEQ ID NO: 6551 - RNA, 38 nt, Artificial Sequence
  Description of Artificial Sequence:  Enzymatic Nucleic Acid
  misc_feature (18)..(25): n stands for any nucleotide and can be optionally absent
agcaauaacugaugaggnnnnnnnnccgaaaggcuuug

SEQ ID NO: 6552 - RNA, 38 nt, Artificial Sequence
  Description of Artificial Sequence:  Enzymatic Nucleic Acid
  misc_feature (18)..(25): n stands for any nucleotide and can be optionally absent
aagcaauacugaugaggnnnnnnnnccgaaaaggcuuu

SEQ ID NO: 6553 - RNA, 38 nt, Artificial Sequence
  Description of Artificial Sequence:  Enzymatic Nucleic Acid
  misc_feature (18)..(25): n stands for any nucleotide and can be optionally absent
aaagcaaucugaugaggnnnnnnnnccgaaaaaggcuu

SEQ ID NO: 6554 - RNA, 38 nt, Artificial Sequence
  Description of Artificial Sequence:  Enzymatic Nucleic Acid
  misc_feature (18)..(25): n stands for any nucleotide and can be optionally absent
gaaagcaacugaugaggnnnnnnnnccgaaaaaaggcu

SEQ ID NO: 6555 - RNA, 38 nt, Artificial Sequence
  Description of Artificial Sequence:  Enzymatic Nucleic Acid
  misc_feature (18)..(25): n stands for any nucleotide and can be optionally absent
ccgaaagccugaugaggnnnnnnnnccgaaauaaaagg

SEQ ID NO: 6556 - RNA, 38 nt, Artificial Sequence
  Description of Artificial Sequence:  Enzymatic Nucleic Acid
  misc_feature (18)..(25): n stands for any nucleotide and can be optionally absent
acuaccgacugaugaggnnnnnnnnccgaaagcaauaa

SEQ ID NO: 6557 - RNA, 38 nt, Artificial Sequence
  Description of Artificial Sequence:  Enzymatic Nucleic Acid
  misc_feature (18)..(25): n stands for any nucleotide and can be optionally absent
cacuaccgcugaugaggnnnnnnnnccgaaaagcaaua

SEQ ID NO: 6558 - RNA, 38 nt, Artificial Sequence
  Description of Artificial Sequence:  Enzymatic Nucleic Acid
  misc_feature (18)..(25): n stands for any nucleotide and can be optionally absent
ccacuacccugaugaggnnnnnnnnccgaaaaagcaau

SEQ ID NO: 6559 - RNA, 38 nt, Artificial Sequence
  Description of Artificial Sequence:  Enzymatic Nucleic Acid
  misc_feature (18)..(25): n stands for any nucleotide and can be optionally absent
caucccaccugaugaggnnnnnnnnccgaaaccgaaag

SEQ ID NO: 6560 - RNA, 38 nt, Artificial Sequence
  Description of Artificial Sequence:  Enzymatic Nucleic Acid
  misc_feature (18)..(25): n stands for any nucleotide and can be optionally absent
ccaccaaacugaugaggnnnnnnnnccgaaauuucauc

SEQ ID NO: 6561 - RNA, 38 nt, Artificial Sequence
  Description of Artificial Sequence:  Enzymatic Nucleic Acid
  misc_feature (18)..(25): n stands for any nucleotide and can be optionally absent
uuccaccacugaugaggnnnnnnnnccgaaagauuuca

SEQ ID NO: 6562 - RNA, 38 nt, Artificial Sequence
  Description of Artificial Sequence:  Enzymatic Nucleic Acid
  misc_feature (18)..(25): n stands for any nucleotide and can be optionally absent
cuuccacccugaugaggnnnnnnnnccgaaaagauuuc

SEQ ID NO: 6563 - RNA, 38 nt, Artificial Sequence
  Description of Artificial Sequence:  Enzymatic Nucleic Acid
  misc_feature (18)..(25): n stands for any nucleotide and can be optionally absent
ucggacuucugaugaggnnnnnnnnccgaaacugccca

SEQ ID NO: 6564 - RNA, 38 nt, Artificial Sequence
  Description of Artificial Sequence:  Enzymatic Nucleic Acid
  misc_feature (18)..(25): n stands for any nucleotide and can be optionally absent
gggauucgcugaugaggnnnnnnnnccgaaacuugacu

SEQ ID NO: 6565 - RNA, 38 nt, Artificial Sequence
  Description of Artificial Sequence:  Enzymatic Nucleic Acid
  misc_feature (18)..(25): n stands for any nucleotide and can be optionally absent
uucacaggcugaugaggnnnnnnnnccgaaauucggac

SEQ ID NO: 6566 - RNA, 38 nt, Artificial Sequence
  Description of Artificial Sequence:  Enzymatic Nucleic Acid
  misc_feature (18)..(25): n stands for any nucleotide and can be optionally absent
aacugagacugaugaggnnnnnnnnccgaaacuucaca

SEQ ID NO: 6567 - RNA, 38 nt, Artificial Sequence
  Description of Artificial Sequence:  Enzymatic Nucleic Acid
  misc_feature (18)..(25): n stands for any nucleotide and can be optionally absent
guaacugacugaugaggnnnnnnnnccgaaauacuuca

SEQ ID NO: 6568 - RNA, 38 nt, Artificial Sequence
  Description of Artificial Sequence:  Enzymatic Nucleic Acid
  misc_feature (18)..(25): n stands for any nucleotide and can be optionally absent
ggguaacucugaugaggnnnnnnnnccgaaagauacuu

SEQ ID NO: 6569 - RNA, 38 nt, Artificial Sequence
  Description of Artificial Sequence:  Enzymatic Nucleic Acid
  misc_feature (18)..(25): n stands for any nucleotide and can be optionally absent
agcugggucugaugaggnnnnnnnnccgaaacugagau

SEQ ID NO: 6570 - RNA, 38 nt, Artificial Sequence
  Description of Artificial Sequence:  Enzymatic Nucleic Acid
  misc_feature (18)..(25): n stands for any nucleotide and can be optionally absent
gagcugggcugaugaggnnnnnnnnccgaaaacugaga

SEQ ID NO: 6571 - RNA, 38 nt, Artificial Sequence
  Description of Artificial Sequence:  Enzymatic Nucleic Acid
  misc_feature (18)..(25): n stands for any nucleotide and can be optionally absent
gauaucagcugaugaggnnnnnnnnccgaaagcugggu

SEQ ID NO: 6572 - RNA, 38 nt, Artificial Sequence
  Description of Artificial Sequence:  Enzymatic Nucleic Acid
  misc_feature (18)..(25): n stands for any nucleotide and can be optionally absent
ccauuugacugaugaggnnnnnnnnccgaaaucaggag

SEQ ID NO: 6573 - RNA, 38 nt, Artificial Sequence
  Description of Artificial Sequence:  Enzymatic Nucleic Acid
  misc_feature (18)..(25): n stands for any nucleotide and can be optionally absent
uaccauuucugaugaggnnnnnnnnccgaaauaucagg

SEQ ID NO: 6574 - RNA, 38 nt, Artificial Sequence
  Description of Artificial Sequence:  Enzymatic Nucleic Acid
  misc_feature (18)..(25): n stands for any nucleotide and can be optionally absent
cauuucugcugaugaggnnnnnnnnccgaaaccauuug

SEQ ID NO: 6575 - RNA, 38 nt, Artificial Sequence
  Description of Artificial Sequence:  Enzymatic Nucleic Acid
  misc_feature (18)..(25): n stands for any nucleotide and can be optionally absent
uuggacuccugaugaggnnnnnnnnccgaaaugggccu

SEQ ID NO: 6576 - RNA, 38 nt, Artificial Sequence
  Description of Artificial Sequence:  Enzymatic Nucleic Acid
  misc_feature (18)..(25): n stands for any nucleotide and can be optionally absent
uguaguugcugaugaggnnnnnnnnccgaaacucaaug

SEQ ID NO: 6577 - RNA, 38 nt, Artificial Sequence
  Description of Artificial Sequence:  Enzymatic Nucleic Acid
  misc_feature (18)..(25): n stands for any nucleotide and can be optionally absent
ucauugugcugaugaggnnnnnnnnccgaaaguuggac

SEQ ID NO: 6578 - RNA, 38 nt, Artificial Sequence
  Description of Artificial Sequence:  Enzymatic Nucleic Acid
  misc_feature (18)..(25): n stands for any nucleotide and can be optionally absent
ucgccaaccugaugaggnnnnnnnnccgaaaucauugu

SEQ ID NO: 6579 - RNA, 38 nt, Artificial Sequence
  Description of Artificial Sequence:  Enzymatic Nucleic Acid
  misc_feature (18)..(25): n stands for any nucleotide and can be optionally absent
ucaucgcccugaugaggnnnnnnnnccgaaacaaucau

SEQ ID NO: 6580 - RNA, 38 nt, Artificial Sequence
  Description of Artificial Sequence:  Enzymatic Nucleic Acid
  misc_feature (18)..(25): n stands for any nucleotide and can be optionally absent
augauggucugaugaggnnnnnnnnccgaaaguucauc

SEQ ID NO: 6581 - RNA, 38 nt, Artificial Sequence
  Description of Artificial Sequence:  Enzymatic Nucleic Acid
  misc_feature (18)..(25): n stands for any nucleotide and can be optionally absent
acuuccaucugaugaggnnnnnnnnccgaaauggugag

SEQ ID NO: 6582 - RNA, 38 nt, Artificial Sequence
  Description of Artificial Sequence:  Enzymatic Nucleic Acid
  misc_feature (18)..(25): n stands for any nucleotide and can be optionally absent
ugaccgugcugaugaggnnnnnnnnccgaaaguuuccu

SEQ ID NO: 6583 - RNA, 38 nt, Artificial Sequence
  Description of Artificial Sequence:  Enzymatic Nucleic Acid
  misc_feature (18)..(25): n stands for any nucleotide and can be optionally absent
gugaggaucugaugaggnnnnnnnnccgaaaccgugua

SEQ ID NO: 6584 - RNA, 38 nt, Artificial Sequence
  Description of Artificial Sequence:  Enzymatic Nucleic Acid
  misc_feature (18)..(25): n stands for any nucleotide and can be optionally absent
uuggugagcugaugaggnnnnnnnnccgaaaugaccgu

SEQ ID NO: 6585 - RNA, 38 nt, Artificial Sequence
  Description of Artificial Sequence:  Enzymatic Nucleic Acid
  misc_feature (18)..(25): n stands for any nucleotide and can be optionally absent
ggguuggucugaugaggnnnnnnnnccgaaaggaugac

SEQ ID NO: 6586 - RNA, 38 nt, Artificial Sequence
  Description of Artificial Sequence:  Enzymatic Nucleic Acid
  misc_feature (18)..(25): n stands for any nucleotide and can be optionally absent
uccauugacugaugaggnnnnnnnnccgaaaugggguu

SEQ ID NO: 6587 - RNA, 38 nt, Artificial Sequence
  Description of Artificial Sequence:  Enzymatic Nucleic Acid
  misc_feature (18)..(25): n stands for any nucleotide and can be optionally absent
cuccauugcugaugaggnnnnnnnnccgaaaauggggu

SEQ ID NO: 6588 - RNA, 38 nt, Artificial Sequence
  Description of Artificial Sequence:  Enzymatic Nucleic Acid
  misc_feature (18)..(25): n stands for any nucleotide and can be optionally absent
ucuccauucugaugaggnnnnnnnnccgaaaaaugggg

SEQ ID NO: 6589 - RNA, 38 nt, Artificial Sequence
  Description of Artificial Sequence:  Enzymatic Nucleic Acid
  misc_feature (18)..(25): n stands for any nucleotide and can be optionally absent
accagagacugaugaggnnnnnnnnccgaaaccaugug

SEQ ID NO: 6590 - RNA, 38 nt, Artificial Sequence
  Description of Artificial Sequence:  Enzymatic Nucleic Acid
  misc_feature (18)..(25): n stands for any nucleotide and can be optionally absent
caaccagacugaugaggnnnnnnnnccgaaagaccaug

SEQ ID NO: 6591 - RNA, 38 nt, Artificial Sequence
  Description of Artificial Sequence:  Enzymatic Nucleic Acid
  misc_feature (18)..(25): n stands for any nucleotide and can be optionally absent
acauucaccugaugaggnnnnnnnnccgaaaccagaga

SEQ ID NO: 6592 - RNA, 38 nt, Artificial Sequence
  Description of Artificial Sequence:  Enzymatic Nucleic Acid
  misc_feature (18)..(25): n stands for any nucleotide and can be optionally absent
ugggguggcugaugaggnnnnnnnnccgaaacauucac

SEQ ID NO: 6593 - RNA, 38 nt, Artificial Sequence
  Description of Artificial Sequence:  Enzymatic Nucleic Acid
  misc_feature (18)..(25): n stands for any nucleotide and can be optionally absent
gcgagauccugaugaggnnnnnnnnccgaaaggcuuuc

SEQ ID NO: 6594 - RNA, 38 nt, Artificial Sequence
  Description of Artificial Sequence:  Enzymatic Nucleic Acid
  misc_feature (18)..(25): n stands for any nucleotide and can be optionally absent
auaggcgacugaugaggnnnnnnnnccgaaaucaaggc

SEQ ID NO: 6595 - RNA, 38 nt, Artificial Sequence
  Description of Artificial Sequence:  Enzymatic Nucleic Acid
  misc_feature (18)..(25): n stands for any nucleotide and can be optionally absent
ccauaggccugaugaggnnnnnnnnccgaaagaucaag

SEQ ID NO: 6596 - RNA, 38 nt, Artificial Sequence
  Description of Artificial Sequence:  Enzymatic Nucleic Acid
  misc_feature (18)..(25): n stands for any nucleotide and can be optionally absent
ggaauccacugaugaggnnnnnnnnccgaaaggcgaga

SEQ ID NO: 6597 - RNA, 38 nt, Artificial Sequence
  Description of Artificial Sequence:  Enzymatic Nucleic Acid
  misc_feature (18)..(25): n stands for any nucleotide and can be optionally absent
cugguaggcugaugaggnnnnnnnnccgaaauccauag

SEQ ID NO: 6598 - RNA, 38 nt, Artificial Sequence
  Description of Artificial Sequence:  Enzymatic Nucleic Acid
  misc_feature (18)..(25): n stands for any nucleotide and can be optionally absent
acugguagcugaugaggnnnnnnnnccgaaaauccaua

SEQ ID NO: 6599 - RNA, 38 nt, Artificial Sequence
  Description of Artificial Sequence:  Enzymatic Nucleic Acid
  misc_feature (18)..(25): n stands for any nucleotide and can be optionally absent
cauacuggcugaugaggnnnnnnnnccgaaaggaaucc

SEQ ID NO: 6600 - RNA, 38 nt, Artificial Sequence
  Description of Artificial Sequence:  Enzymatic Nucleic Acid
  misc_feature (18)..(25): n stands for any nucleotide and can be optionally absent
uggucccacugaugaggnnnnnnnnccgaaacugguag

SEQ ID NO: 6601 - RNA, 38 nt, Artificial Sequence
  Description of Artificial Sequence:  Enzymatic Nucleic Acid
  misc_feature (18)..(25): n stands for any nucleotide and can be optionally absent
ugcauguccugaugaggnnnnnnnnccgaaaugucugc

SEQ ID NO: 6602 - RNA, 38 nt, Artificial Sequence
  Description of Artificial Sequence:  Enzymatic Nucleic Acid
  misc_feature (18)..(25): n stands for any nucleotide and can be optionally absent
uuggcguacugaugaggnnnnnnnnccgaaacugugca

SEQ ID NO: 6603 - RNA, 38 nt, Artificial Sequence
  Description of Artificial Sequence:  Enzymatic Nucleic Acid
  misc_feature (18)..(25): n stands for any nucleotide and can be optionally absent
gguuggcgcugaugaggnnnnnnnnccgaaagacugug

SEQ ID NO: 6604 - RNA, 38 nt, Artificial Sequence
  Description of Artificial Sequence:  Enzymatic Nucleic Acid
  misc_feature (18)..(25): n stands for any nucleotide and can be optionally absent
gugcagggcugaugaggnnnnnnnnccgaaaggguugg

SEQ ID NO: 6605 - RNA, 38 nt, Artificial Sequence
  Description of Artificial Sequence:  Enzymatic Nucleic Acid
  misc_feature (18)..(25): n stands for any nucleotide and can be optionally absent
uaccacugcugaugaggnnnnnnnnccgaaauguggug

SEQ ID NO: 6606 - RNA, 38 nt, Artificial Sequence
  Description of Artificial Sequence:  Enzymatic Nucleic Acid
  misc_feature (18)..(25): n stands for any nucleotide and can be optionally absent
gcugccagcugaugaggnnnnnnnnccgaaaccacugg

SEQ ID NO: 6607 - RNA, 38 nt, Artificial Sequence
  Description of Artificial Sequence:  Enzymatic Nucleic Acid
  misc_feature (18)..(25): n stands for any nucleotide and can be optionally absent
gcuucuuccugaugaggnnnnnnnnccgaaagcugcca

SEQ ID NO: 6608 - RNA, 38 nt, Artificial Sequence
  Description of Artificial Sequence:  Enzymatic Nucleic Acid
  misc_feature (18)..(25): n stands for any nucleotide and can be optionally absent
gucuguagcugaugaggnnnnnnnnccgaaagcaggcu

SEQ ID NO: 6609 - RNA, 38 nt, Artificial Sequence
  Description of Artificial Sequence:  Enzymatic Nucleic Acid
  misc_feature (18)..(25): n stands for any nucleotide and can be optionally absent
cgggucugcugaugaggnnnnnnnnccgaaaggagcag

SEQ ID NO: 6610 - RNA, 38 nt, Artificial Sequence
  Description of Artificial Sequence:  Enzymatic Nucleic Acid
  misc_feature (18)..(25): n stands for any nucleotide and can be optionally absent
uacaagcacugaugaggnnnnnnnnccgaaacgggcuu

SEQ ID NO: 6611 - RNA, 38 nt, Artificial Sequence
  Description of Artificial Sequence:  Enzymatic Nucleic Acid
  misc_feature (18)..(25): n stands for any nucleotide and can be optionally absent
uucuuuaccugaugaggnnnnnnnnccgaaagcauacg

SEQ ID NO: 6612 - RNA, 38 nt, Artificial Sequence
  Description of Artificial Sequence:  Enzymatic Nucleic Acid
  misc_feature (18)..(25): n stands for any nucleotide and can be optionally absent
ccauucuucugaugaggnnnnnnnnccgaaacaagcau

SEQ ID NO: 6613 - RNA, 38 nt, Artificial Sequence
  Description of Artificial Sequence:  Enzymatic Nucleic Acid
  misc_feature (18)..(25): n stands for any nucleotide and can be optionally absent
ccccuggacugaugaggnnnnnnnnccgaaauccucca

SEQ ID NO: 6614 - RNA, 38 nt, Artificial Sequence
  Description of Artificial Sequence:  Enzymatic Nucleic Acid
  misc_feature (18)..(25): n stands for any nucleotide and can be optionally absent
cccccuggcugaugaggnnnnnnnnccgaaaauccucc

SEQ ID NO: 6615 - RNA, 38 nt, Artificial Sequence
  Description of Artificial Sequence:  Enzymatic Nucleic Acid
  misc_feature (18)..(25): n stands for any nucleotide and can be optionally absent
ccccccugcugaugaggnnnnnnnnccgaaaaauccuc

SEQ ID NO: 6616 - RNA, 38 nt, Artificial Sequence
  Description of Artificial Sequence:  Enzymatic Nucleic Acid
  misc_feature (18)..(25): n stands for any nucleotide and can be optionally absent
gugacuuccugaugaggnnnnnnnnccgaaaucuuguu

SEQ ID NO: 6617 - RNA, 38 nt, Artificial Sequence
  Description of Artificial Sequence:  Enzymatic Nucleic Acid
  misc_feature (18)..(25): n stands for any nucleotide and can be optionally absent
uuuuuggucugaugaggnnnnnnnnccgaaacuucgau

SEQ ID NO: 6618 - RNA, 38 nt, Artificial Sequence
  Description of Artificial Sequence:  Enzymatic Nucleic Acid
  misc_feature (18)..(25): n stands for any nucleotide and can be optionally absent
ucagggcacugaugaggnnnnnnnnccgaaauugguuu

SEQ ID NO: 6619 - RNA, 38 nt, Artificial Sequence
  Description of Artificial Sequence:  Enzymatic Nucleic Acid
  misc_feature (18)..(25): n stands for any nucleotide and can be optionally absent
uuuccuuccugaugaggnnnnnnnnccgaaaucagggc

SEQ ID NO: 6620 - RNA, 38 nt, Artificial Sequence
  Description of Artificial Sequence:  Enzymatic Nucleic Acid
  misc_feature (18)..(25): n stands for any nucleotide and can be optionally absent
agcguacucugaugaggnnnnnnnnccgaaacaguuuu

SEQ ID NO: 6621 - RNA, 38 nt, Artificial Sequence
  Description of Artificial Sequence:  Enzymatic Nucleic Acid
  misc_feature (18)..(25): n stands for any nucleotide and can be optionally absent
gaccagcgcugaugaggnnnnnnnnccgaaacuuacag

SEQ ID NO: 6622 - RNA, 38 nt, Artificial Sequence
  Description of Artificial Sequence:  Enzymatic Nucleic Acid
  misc_feature (18)..(25): n stands for any nucleotide and can be optionally absent
gcuuggaucugaugaggnnnnnnnnccgaaaccagcgu

SEQ ID NO: 6623 - RNA, 38 nt, Artificial Sequence
  Description of Artificial Sequence:  Enzymatic Nucleic Acid
  misc_feature (18)..(25): n stands for any nucleotide and can be optionally absent
gcagcuugcugaugaggnnnnnnnnccgaaaugaccag

SEQ ID NO: 6624 - RNA, 38 nt, Artificial Sequence
  Description of Artificial Sequence:  Enzymatic Nucleic Acid
  misc_feature (18)..(25): n stands for any nucleotide and can be optionally absent
acaacgcucugaugaggnnnnnnnnccgaaacacguug

SEQ ID NO: 6625 - RNA, 38 nt, Artificial Sequence
  Description of Artificial Sequence:  Enzymatic Nucleic Acid
  misc_feature (18)..(25): n stands for any nucleotide and can be optionally absent
auuuguaccugaugaggnnnnnnnnccgaaacgcugac

SEQ ID NO: 6626 - RNA, 38 nt, Artificial Sequence
  Description of Artificial Sequence:  Enzymatic Nucleic Acid
  misc_feature (18)..(25): n stands for any nucleotide and can be optionally absent
cacauuugcugaugaggnnnnnnnnccgaaacaacgcu

SEQ ID NO: 6627 - RNA, 38 nt, Artificial Sequence
  Description of Artificial Sequence:  Enzymatic Nucleic Acid
  misc_feature (18)..(25): n stands for any nucleotide and can be optionally absent
gcuuuguucugaugaggnnnnnnnnccgaaauggcuuc

SEQ ID NO: 6628 - RNA, 38 nt, Artificial Sequence
  Description of Artificial Sequence:  Enzymatic Nucleic Acid
  misc_feature (18)..(25): n stands for any nucleotide and can be optionally absent
aaggagaucugaugaggnnnnnnnnccgaaacccucuc

SEQ ID NO: 6629 - RNA, 38 nt, Artificial Sequence
  Description of Artificial Sequence:  Enzymatic Nucleic Acid
  misc_feature (18)..(25): n stands for any nucleotide and can be optionally absent
uggaaggacugaugaggnnnnnnnnccgaaaugacccu

SEQ ID NO: 6630 - RNA, 38 nt, Artificial Sequence
  Description of Artificial Sequence:  Enzymatic Nucleic Acid
  misc_feature (18)..(25): n stands for any nucleotide and can be optionally absent
cauggaagcugaugaggnnnnnnnnccgaaagaugacc

SEQ ID NO: 6631 - RNA, 38 nt, Artificial Sequence
  Description of Artificial Sequence:  Enzymatic Nucleic Acid
  misc_feature (18)..(25): n stands for any nucleotide and can be optionally absent
ucacauggcugaugaggnnnnnnnnccgaaaggagaug

SEQ ID NO: 6632 - RNA, 38 nt, Artificial Sequence
  Description of Artificial Sequence:  Enzymatic Nucleic Acid
  misc_feature (18)..(25): n stands for any nucleotide and can be optionally absent
aucacaugcugaugaggnnnnnnnnccgaaaaggagau

SEQ ID NO: 6633 - RNA, 38 nt, Artificial Sequence
  Description of Artificial Sequence:  Enzymatic Nucleic Acid
  misc_feature (18)..(25): n stands for any nucleotide and can be optionally absent
ggaccccucugaugaggnnnnnnnnccgaaaucacaug

SEQ ID NO: 6634 - RNA, 38 nt, Artificial Sequence
  Description of Artificial Sequence:  Enzymatic Nucleic Acid
  misc_feature (18)..(25): n stands for any nucleotide and can be optionally absent
aauuucagcugaugaggnnnnnnnnccgaaaccccuga

SEQ ID NO: 6635 - RNA, 38 nt, Artificial Sequence
  Description of Artificial Sequence:  Enzymatic Nucleic Acid
  misc_feature (18)..(25): n stands for any nucleotide and can be optionally absent
ugcacagucugaugaggnnnnnnnnccgaaauuucagg

SEQ ID NO: 6636 - RNA, 38 nt, Artificial Sequence
  Description of Artificial Sequence:  Enzymatic Nucleic Acid
  misc_feature (18)..(25): n stands for any nucleotide and can be optionally absent
uugcacagcugaugaggnnnnnnnnccgaaaauuucag

SEQ ID NO: 6637 - RNA, 38 nt, Artificial Sequence
  Description of Artificial Sequence:  Enzymatic Nucleic Acid
  misc_feature (18)..(25): n stands for any nucleotide and can be optionally absent
acaacaggcugaugaggnnnnnnnnccgaaacacacuc

SEQ ID NO: 6638 - RNA, 38 nt, Artificial Sequence
  Description of Artificial Sequence:  Enzymatic Nucleic Acid
  misc_feature (18)..(25): n stands for any nucleotide and can be optionally absent
cagugcaccugaugaggnnnnnnnnccgaaacagggac

SEQ ID NO: 6639 - RNA, 38 nt, Artificial Sequence
  Description of Artificial Sequence:  Enzymatic Nucleic Acid
  misc_feature (18)..(25): n stands for any nucleotide and can be optionally absent
cucaaacgcugaugaggnnnnnnnnccgaaauuucugu

SEQ ID NO: 6640 - RNA, 38 nt, Artificial Sequence
  Description of Artificial Sequence:  Enzymatic Nucleic Acid
  misc_feature (18)..(25): n stands for any nucleotide and can be optionally absent
gguucucacugaugaggnnnnnnnnccgaaacguauuu

SEQ ID NO: 6641 - RNA, 38 nt, Artificial Sequence
  Description of Artificial Sequence:  Enzymatic Nucleic Acid
  misc_feature (18)..(25): n stands for any nucleotide and can be optionally absent
agguucuccugaugaggnnnnnnnnccgaaaacguauu

SEQ ID NO: 6642 - RNA, 38 nt, Artificial Sequence
  Description of Artificial Sequence:  Enzymatic Nucleic Acid
  misc_feature (18)..(25): n stands for any nucleotide and can be optionally absent
uaccacgucugaugaggnnnnnnnnccgaaagguucuc

SEQ ID NO: 6643 - RNA, 38 nt, Artificial Sequence
  Description of Artificial Sequence:  Enzymatic Nucleic Acid
  misc_feature (18)..(25): n stands for any nucleotide and can be optionally absent
caagcuugcugaugaggnnnnnnnnccgaaaccacgug

SEQ ID NO: 6644 - RNA, 38 nt, Artificial Sequence
  Description of Artificial Sequence:  Enzymatic Nucleic Acid
  misc_feature (18)..(25): n stands for any nucleotide and can be optionally absent
ugugagcccugaugaggnnnnnnnnccgaaagcuugua

SEQ ID NO: 6645 - RNA, 38 nt, Artificial Sequence
  Description of Artificial Sequence:  Enzymatic Nucleic Acid
  misc_feature (18)..(25): n stands for any nucleotide and can be optionally absent
uugccugucugaugaggnnnnnnnnccgaaagccaagc

SEQ ID NO: 6646 - RNA, 38 nt, Artificial Sequence
  Description of Artificial Sequence:  Enzymatic Nucleic Acid
  misc_feature (18)..(25): n stands for any nucleotide and can be optionally absent
uguggacccugaugaggnnnnnnnnccgaaauguugcc

SEQ ID NO: 6647 - RNA, 38 nt, Artificial Sequence
  Description of Artificial Sequence:  Enzymatic Nucleic Acid
  misc_feature (18)..(25): n stands for any nucleotide and can be optionally absent
cccaugugcugaugaggnnnnnnnnccgaaaccgaugu

SEQ ID NO: 6648 - RNA, 38 nt, Artificial Sequence
  Description of Artificial Sequence:  Enzymatic Nucleic Acid
  misc_feature (18)..(25): n stands for any nucleotide and can be optionally absent
gugugagucugaugaggnnnnnnnnccgaaauucgccc

SEQ ID NO: 6649 - RNA, 38 nt, Artificial Sequence
  Description of Artificial Sequence:  Enzymatic Nucleic Acid
  misc_feature (18)..(25): n stands for any nucleotide and can be optionally absent
acuggugucugaugaggnnnnnnnnccgaaagugauuc

SEQ ID NO: 6650 - RNA, 38 nt, Artificial Sequence
  Description of Artificial Sequence:  Enzymatic Nucleic Acid
  misc_feature (18)..(25): n stands for any nucleotide and can be optionally absent
uucuugcacugaugaggnnnnnnnnccgaaacuggugu

SEQ ID NO: 6651 - RNA, 38 nt, Artificial Sequence
  Description of Artificial Sequence:  Enzymatic Nucleic Acid
  misc_feature (18)..(25): n stands for any nucleotide and can be optionally absent
guucuugccugaugaggnnnnnnnnccgaaaacuggug

SEQ ID NO: 6652 - RNA, 38 nt, Artificial Sequence
  Description of Artificial Sequence:  Enzymatic Nucleic Acid
  misc_feature (18)..(25): n stands for any nucleotide and can be optionally absent
gagcaucccugaugaggnnnnnnnnccgaaaguucuug

SEQ ID NO: 6653 - RNA, 38 nt, Artificial Sequence
  Description of Artificial Sequence:  Enzymatic Nucleic Acid
  misc_feature (18)..(25): n stands for any nucleotide and can be optionally absent
uuuccaaacugaugaggnnnnnnnnccgaaagcaucca

SEQ ID NO: 6654 - RNA, 38 nt, Artificial Sequence
  Description of Artificial Sequence:  Enzymatic Nucleic Acid
  misc_feature (18)..(25): n stands for any nucleotide and can be optionally absent
aguuuccacugaugaggnnnnnnnnccgaaagagcauc

SEQ ID NO: 6655 - RNA, 38 nt, Artificial Sequence
  Description of Artificial Sequence:  Enzymatic Nucleic Acid
  misc_feature (18)..(25): n stands for any nucleotide and can be optionally absent
caguuucccugaugaggnnnnnnnnccgaaaagagcau

SEQ ID NO: 6656 - RNA, 38 nt, Artificial Sequence
  Description of Artificial Sequence:  Enzymatic Nucleic Acid
  misc_feature (18)..(25): n stands for any nucleotide and can be optionally absent
uguuagaacugaugaggnnnnnnnnccgaaacauggug

SEQ ID NO: 6657 - RNA, 38 nt, Artificial Sequence
  Description of Artificial Sequence:  Enzymatic Nucleic Acid
  misc_feature (18)..(25): n stands for any nucleotide and can be optionally absent
cuguuagacugaugaggnnnnnnnnccgaaaacauggu

SEQ ID NO: 6658 - RNA, 38 nt, Artificial Sequence
  Description of Artificial Sequence:  Enzymatic Nucleic Acid
  misc_feature (18)..(25): n stands for any nucleotide and can be optionally absent
gcuguuagcugaugaggnnnnnnnnccgaaaaacaugg

SEQ ID NO: 6659 - RNA, 38 nt, Artificial Sequence
  Description of Artificial Sequence:  Enzymatic Nucleic Acid
  misc_feature (18)..(25): n stands for any nucleotide and can be optionally absent
ugcuguuacugaugaggnnnnnnnnccgaaaaaacaug

SEQ ID NO: 6660 - RNA, 38 nt, Artificial Sequence
  Description of Artificial Sequence:  Enzymatic Nucleic Acid
  misc_feature (18)..(25): n stands for any nucleotide and can be optionally absent
ugugcugucugaugaggnnnnnnnnccgaaagaaaaca

SEQ ID NO: 6661 - RNA, 38 nt, Artificial Sequence
  Description of Artificial Sequence:  Enzymatic Nucleic Acid
  misc_feature (18)..(25): n stands for any nucleotide and can be optionally absent
acaaucaacugaugaggnnnnnnnnccgaaaugucauu

SEQ ID NO: 6662 - RNA, 38 nt, Artificial Sequence
  Description of Artificial Sequence:  Enzymatic Nucleic Acid
  misc_feature (18)..(25): n stands for any nucleotide and can be optionally absent
ccacaauccugaugaggnnnnnnnnccgaaagauguca

SEQ ID NO: 6663 - RNA, 38 nt, Artificial Sequence
  Description of Artificial Sequence:  Enzymatic Nucleic Acid
  misc_feature (18)..(25): n stands for any nucleotide and can be optionally absent
aaugccaccugaugaggnnnnnnnnccgaaaucaagau

SEQ ID NO: 6664 - RNA, 38 nt, Artificial Sequence
  Description of Artificial Sequence:  Enzymatic Nucleic Acid
  misc_feature (18)..(25): n stands for any nucleotide and can be optionally absent
cauucugacugaugaggnnnnnnnnccgaaaugccaca

SEQ ID NO: 6665 - RNA, 38 nt, Artificial Sequence
  Description of Artificial Sequence:  Enzymatic Nucleic Acid
  misc_feature (18)..(25): n stands for any nucleotide and can be optionally absent
gcauucugcugaugaggnnnnnnnnccgaaaaugccac

SEQ ID NO: 6666 - RNA, 38 nt, Artificial Sequence
  Description of Artificial Sequence:  Enzymatic Nucleic Acid
  misc_feature (18)..(25): n stands for any nucleotide and can be optionally absent
ggcauucucugaugaggnnnnnnnnccgaaaaaugcca

SEQ ID NO: 6667 - RNA, 38 nt, Artificial Sequence
  Description of Artificial Sequence:  Enzymatic Nucleic Acid
  misc_feature (18)..(25): n stands for any nucleotide and can be optionally absent
ccugcagacugaugaggnnnnnnnnccgaaaggcauuc

SEQ ID NO: 6668 - RNA, 38 nt, Artificial Sequence
  Description of Artificial Sequence:  Enzymatic Nucleic Acid
  misc_feature (18)..(25): n stands for any nucleotide and can be optionally absent
guccugcacugaugaggnnnnnnnnccgaaagaggcau

SEQ ID NO: 6669 - RNA, 38 nt, Artificial Sequence
  Description of Artificial Sequence:  Enzymatic Nucleic Acid
  misc_feature (18)..(25): n stands for any nucleotide and can be optionally absent
agcaaacacugaugaggnnnnnnnnccgaaagucgccu

SEQ ID NO: 6670 - RNA, 38 nt, Artificial Sequence
  Description of Artificial Sequence:  Enzymatic Nucleic Acid
  misc_feature (18)..(25): n stands for any nucleotide and can be optionally absent
gcagagcacugaugaggnnnnnnnnccgaaacauaguc

SEQ ID NO: 6671 - RNA, 38 nt, Artificial Sequence
  Description of Artificial Sequence:  Enzymatic Nucleic Acid
  misc_feature (18)..(25): n stands for any nucleotide and can be optionally absent
agcagagccugaugaggnnnnnnnnccgaaaacauagu

SEQ ID NO: 6672 - RNA, 38 nt, Artificial Sequence
  Description of Artificial Sequence:  Enzymatic Nucleic Acid
  misc_feature (18)..(25): n stands for any nucleotide and can be optionally absent
cuugagcacugaugaggnnnnnnnnccgaaagcaaaca

SEQ ID NO: 6673 - RNA, 38 nt, Artificial Sequence
  Description of Artificial Sequence:  Enzymatic Nucleic Acid
  misc_feature (18)..(25): n stands for any nucleotide and can be optionally absent
cuuaucuucugaugaggnnnnnnnnccgaaagcagagc

SEQ ID NO: 6674 - RNA, 38 nt, Artificial Sequence
  Description of Artificial Sequence:  Enzymatic Nucleic Acid
  misc_feature (18)..(25): n stands for any nucleotide and can be optionally absent
ggucuucucugaugaggnnnnnnnnccgaaaucuugag

SEQ ID NO: 6675 - RNA, 38 nt, Artificial Sequence
  Description of Artificial Sequence:  Enzymatic Nucleic Acid
  misc_feature (18)..(25): n stands for any nucleotide and can be optionally absent
gaccaggccugaugaggnnnnnnnnccgaaaugucuuu

SEQ ID NO: 6676 - RNA, 38 nt, Artificial Sequence
  Description of Artificial Sequence:  Enzymatic Nucleic Acid
  misc_feature (18)..(25): n stands for any nucleotide and can be optionally absent
agcuguuucugaugaggnnnnnnnnccgaaaccaggca

SEQ ID NO: 6677 - RNA, 38 nt, Artificial Sequence
  Description of Artificial Sequence:  Enzymatic Nucleic Acid
  misc_feature (18)..(25): n stands for any nucleotide and can be optionally absent
aggaugaucugaugaggnnnnnnnnccgaaagcuguuu

SEQ ID NO: 6678 - RNA, 38 nt, Artificial Sequence
  Description of Artificial Sequence:  Enzymatic Nucleic Acid
  misc_feature (18)..(25): n stands for any nucleotide and can be optionally absent
ucuaggaucugaugaggnnnnnnnnccgaaaugagcug

SEQ ID NO: 6679 - RNA, 38 nt, Artificial Sequence
  Description of Artificial Sequence:  Enzymatic Nucleic Acid
  misc_feature (18)..(25): n stands for any nucleotide and can be optionally absent
cgcucuagcugaugaggnnnnnnnnccgaaaugaugag

SEQ ID NO: 6680 - RNA, 38 nt, Artificial Sequence
  Description of Artificial Sequence:  Enzymatic Nucleic Acid
  misc_feature (18)..(25): n stands for any nucleotide and can be optionally absent
augcgcuccugaugaggnnnnnnnnccgaaaggaugau

SEQ ID NO: 6681 - RNA, 38 nt, Artificial Sequence
  Description of Artificial Sequence:  Enzymatic Nucleic Acid
  misc_feature (18)..(25): n stands for any nucleotide and can be optionally absent
uuuccggucugaugaggnnnnnnnnccgaaaucauggg

SEQ ID NO: 6682 - RNA, 38 nt, Artificial Sequence
  Description of Artificial Sequence:  Enzymatic Nucleic Acid
  misc_feature (18)..(25): n stands for any nucleotide and can be optionally absent
auucuccacugaugaggnnnnnnnnccgaaauuuccgg

SEQ ID NO: 6683 - RNA, 38 nt, Artificial Sequence
  Description of Artificial Sequence:  Enzymatic Nucleic Acid
  misc_feature (18)..(25): n stands for any nucleotide and can be optionally absent
uguugucucugaugaggnnnnnnnnccgaaauucucca

SEQ ID NO: 6684 - RNA, 38 nt, Artificial Sequence
  Description of Artificial Sequence:  Enzymatic Nucleic Acid
  misc_feature (18)..(25): n stands for any nucleotide and can be optionally absent
gucucgcccugaugaggnnnnnnnnccgaaaugguugu

SEQ ID NO: 6685 - RNA, 38 nt, Artificial Sequence
  Description of Artificial Sequence:  Enzymatic Nucleic Acid
  misc_feature (18)..(25): n stands for any nucleotide and can be optionally absent
gucacuuccugaugaggnnnnnnnnccgaaauggucuc

SEQ ID NO: 6686 - RNA, 38 nt, Artificial Sequence
  Description of Artificial Sequence:  Enzymatic Nucleic Acid
  misc_feature (18)..(25): n stands for any nucleotide and can be optionally absent
ugcugggccugaugaggnnnnnnnnccgaaagucacuu

SEQ ID NO: 6687 - RNA, 38 nt, Artificial Sequence
  Description of Artificial Sequence:  Enzymatic Nucleic Acid
  misc_feature (18)..(25): n stands for any nucleotide and can be optionally absent
gauuuccacugaugaggnnnnnnnnccgaaaugcuggg

SEQ ID NO: 6688 - RNA, 38 nt, Artificial Sequence
  Description of Artificial Sequence:  Enzymatic Nucleic Acid
  misc_feature (18)..(25): n stands for any nucleotide and can be optionally absent
ugggguagcugaugaggnnnnnnnnccgaaauuuccag

SEQ ID NO: 6689 - RNA, 38 nt, Artificial Sequence
  Description of Artificial Sequence:  Enzymatic Nucleic Acid
  misc_feature (18)..(25): n stands for any nucleotide and can be optionally absent
guguggggcugaugaggnnnnnnnnccgaaaggauuuc

SEQ ID NO: 6690 - RNA, 38 nt, Artificial Sequence
  Description of Artificial Sequence:  Enzymatic Nucleic Acid
  misc_feature (18)..(25): n stands for any nucleotide and can be optionally absent
aaccaugucugaugaggnnnnnnnnccgaaaugugugg

SEQ ID NO: 6691 - RNA, 38 nt, Artificial Sequence
  Description of Artificial Sequence:  Enzymatic Nucleic Acid
  misc_feature (18)..(25): n stands for any nucleotide and can be optionally absent
gaaccaugcugaugaggnnnnnnnnccgaaaaugugug

SEQ ID NO: 6692 - RNA, 38 nt, Artificial Sequence
  Description of Artificial Sequence:  Enzymatic Nucleic Acid
  misc_feature (18)..(25): n stands for any nucleotide and can be optionally absent
ugucuuugcugaugaggnnnnnnnnccgaaaccaugua

SEQ ID NO: 6693 - RNA, 38 nt, Artificial Sequence
  Description of Artificial Sequence:  Enzymatic Nucleic Acid
  misc_feature (18)..(25): n stands for any nucleotide and can be optionally absent
uugucuuucugaugaggnnnnnnnnccgaaaaccaugu

SEQ ID NO: 6694 - RNA, 38 nt, Artificial Sequence
  Description of Artificial Sequence:  Enzymatic Nucleic Acid
  misc_feature (18)..(25): n stands for any nucleotide and can be optionally absent
gaaucuuccugaugaggnnnnnnnnccgaaaccagggu

SEQ ID NO: 6695 - RNA, 38 nt, Artificial Sequence
  Description of Artificial Sequence:  Enzymatic Nucleic Acid
  misc_feature (18)..(25): n stands for any nucleotide and can be optionally absent
aaugccugcugaugaggnnnnnnnnccgaaaucuucua

SEQ ID NO: 6696 - RNA, 38 nt, Artificial Sequence
  Description of Artificial Sequence:  Enzymatic Nucleic Acid
  misc_feature (18)..(25): n stands for any nucleotide and can be optionally absent
caaugccucugaugaggnnnnnnnnccgaaaaucuucu

SEQ ID NO: 6697 - RNA, 38 nt, Artificial Sequence
  Description of Artificial Sequence:  Enzymatic Nucleic Acid
  misc_feature (18)..(25): n stands for any nucleotide and can be optionally absent
cucaguaccugaugaggnnnnnnnnccgaaaugccuga

SEQ ID NO: 6698 - RNA, 38 nt, Artificial Sequence
  Description of Artificial Sequence:  Enzymatic Nucleic Acid
  misc_feature (18)..(25): n stands for any nucleotide and can be optionally absent
ucucucagcugaugaggnnnnnnnnccgaaacaaugcc

SEQ ID NO: 6699 - RNA, 38 nt, Artificial Sequence
  Description of Artificial Sequence:  Enzymatic Nucleic Acid
  misc_feature (18)..(25): n stands for any nucleotide and can be optionally absent
ccugcggacugaugaggnnnnnnnnccgaaagucaggu

SEQ ID NO: 6700 - RNA, 38 nt, Artificial Sequence
  Description of Artificial Sequence:  Enzymatic Nucleic Acid
  misc_feature (18)..(25): n stands for any nucleotide and can be optionally absent
acccugcgcugaugaggnnnnnnnnccgaaauagucag

SEQ ID NO: 6701 - RNA, 38 nt, Artificial Sequence
  Description of Artificial Sequence:  Enzymatic Nucleic Acid
  misc_feature (18)..(25): n stands for any nucleotide and can be optionally absent
cagguguacugaugaggnnnnnnnnccgaaaggccucc

SEQ ID NO: 6702 - RNA, 38 nt, Artificial Sequence
  Description of Artificial Sequence:  Enzymatic Nucleic Acid
  misc_feature (18)..(25): n stands for any nucleotide and can be optionally absent
cagccaagcugaugaggnnnnnnnnccgaaacauugca

SEQ ID NO: 6703 - RNA, 38 nt, Artificial Sequence
  Description of Artificial Sequence:  Enzymatic Nucleic Acid
  misc_feature (18)..(25): n stands for any nucleotide and can be optionally absent
gcacagcccugaugaggnnnnnnnnccgaaaggacauu

SEQ ID NO: 6704 - RNA, 38 nt, Artificial Sequence
  Description of Artificial Sequence:  Enzymatic Nucleic Acid
  misc_feature (18)..(25): n stands for any nucleotide and can be optionally absent
auuaugaacugaugaggnnnnnnnnccgaaagcgucuc

SEQ ID NO: 6705 - RNA, 38 nt, Artificial Sequence
  Description of Artificial Sequence:  Enzymatic Nucleic Acid
  misc_feature (18)..(25): n stands for any nucleotide and can be optionally absent
cuauuaugcugaugaggnnnnnnnnccgaaagagcguc

SEQ ID NO: 6706 - RNA, 38 nt, Artificial Sequence
  Description of Artificial Sequence:  Enzymatic Nucleic Acid
  misc_feature (18)..(25): n stands for any nucleotide and can be optionally absent
ucuauuaucugaugaggnnnnnnnnccgaaaagagcgu

SEQ ID NO: 6707 - RNA, 38 nt, Artificial Sequence
  Description of Artificial Sequence:  Enzymatic Nucleic Acid
  misc_feature (18)..(25): n stands for any nucleotide and can be optionally absent
ccuucuaucugaugaggnnnnnnnnccgaaaugaagag

SEQ ID NO: 6708 - RNA, 38 nt, Artificial Sequence
  Description of Artificial Sequence:  Enzymatic Nucleic Acid
  misc_feature (18)..(25): n stands for any nucleotide and can be optionally absent
ugacuucccugaugaggnnnnnnnnccgaaaguugguc

SEQ ID NO: 6709 - RNA, 38 nt, Artificial Sequence
  Description of Artificial Sequence:  Enzymatic Nucleic Acid
  misc_feature (18)..(25): n stands for any nucleotide and can be optionally absent
aggauaaucugaugaggnnnnnnnnccgaaacuuccaa

SEQ ID NO: 6710 - RNA, 38 nt, Artificial Sequence
  Description of Artificial Sequence:  Enzymatic Nucleic Acid
  misc_feature (18)..(25): n stands for any nucleotide and can be optionally absent
acgaggaucugaugaggnnnnnnnnccgaaaugacuuc

SEQ ID NO: 6711 - RNA, 38 nt, Artificial Sequence
  Description of Artificial Sequence:  Enzymatic Nucleic Acid
  misc_feature (18)..(25): n stands for any nucleotide and can be optionally absent
gacgaggacugaugaggnnnnnnnnccgaaaaugacuu

SEQ ID NO: 6712 - RNA, 38 nt, Artificial Sequence
  Description of Artificial Sequence:  Enzymatic Nucleic Acid
  misc_feature (18)..(25): n stands for any nucleotide and can be optionally absent
ccgacgagcugaugaggnnnnnnnnccgaaauaaugac

SEQ ID NO: 6713 - RNA, 38 nt, Artificial Sequence
  Description of Artificial Sequence:  Enzymatic Nucleic Acid
  misc_feature (18)..(25): n stands for any nucleotide and can be optionally absent
gugccgaccugaugaggnnnnnnnnccgaaaggauaau

SEQ ID NO: 6714 - RNA, 38 nt, Artificial Sequence
  Description of Artificial Sequence:  Enzymatic Nucleic Acid
  misc_feature (18)..(25): n stands for any nucleotide and can be optionally absent
gcagugcccugaugaggnnnnnnnnccgaaacgaggau

SEQ ID NO: 6715 - RNA, 38 nt, Artificial Sequence
  Description of Artificial Sequence:  Enzymatic Nucleic Acid
  misc_feature (18)..(25): n stands for any nucleotide and can be optionally absent
aacauggccugaugaggnnnnnnnnccgaaaucacugc

SEQ ID NO: 6716 - RNA, 38 nt, Artificial Sequence
  Description of Artificial Sequence:  Enzymatic Nucleic Acid
  misc_feature (18)..(25): n stands for any nucleotide and can be optionally absent
ggagccagcugaugaggnnnnnnnnccgaaagaacaug

SEQ ID NO: 6717 - RNA, 38 nt, Artificial Sequence
  Description of Artificial Sequence:  Enzymatic Nucleic Acid
  misc_feature (18)..(25): n stands for any nucleotide and can be optionally absent
aggagccacugaugaggnnnnnnnnccgaaaagaacau

SEQ ID NO: 6718 - RNA, 38 nt, Artificial Sequence
  Description of Artificial Sequence:  Enzymatic Nucleic Acid
  misc_feature (18)..(25): n stands for any nucleotide and can be optionally absent
augacaagcugaugaggnnnnnnnnccgaaaggagcca

SEQ ID NO: 6719 - RNA, 38 nt, Artificial Sequence
  Description of Artificial Sequence:  Enzymatic Nucleic Acid
  misc_feature (18)..(25): n stands for any nucleotide and can be optionally absent
aaugacaacugaugaggnnnnnnnnccgaaaaggagcc

SEQ ID NO: 6720 - RNA, 38 nt, Artificial Sequence
  Description of Artificial Sequence:  Enzymatic Nucleic Acid
  misc_feature (18)..(25): n stands for any nucleotide and can be optionally absent
acaaugaccugaugaggnnnnnnnnccgaaagaaggag

SEQ ID NO: 6721 - RNA, 38 nt, Artificial Sequence
  Description of Artificial Sequence:  Enzymatic Nucleic Acid
  misc_feature (18)..(25): n stands for any nucleotide and can be optionally absent
aggacaaucugaugaggnnnnnnnnccgaaacaagaag

SEQ ID NO: 6722 - RNA, 38 nt, Artificial Sequence
  Description of Artificial Sequence:  Enzymatic Nucleic Acid
  misc_feature (18)..(25): n stands for any nucleotide and can be optionally absent
cguaggaccugaugaggnnnnnnnnccgaaaugacaag

SEQ ID NO: 6723 - RNA, 38 nt, Artificial Sequence
  Description of Artificial Sequence:  Enzymatic Nucleic Acid
  misc_feature (18)..(25): n stands for any nucleotide and can be optionally absent
guccguagcugaugaggnnnnnnnnccgaaacaaugac

SEQ ID NO: 6724 - RNA, 38 nt, Artificial Sequence
  Description of Artificial Sequence:  Enzymatic Nucleic Acid
  misc_feature (18)..(25): n stands for any nucleotide and can be optionally absent
acgguccgcugaugaggnnnnnnnnccgaaaggacaau

SEQ ID NO: 6725 - RNA, 38 nt, Artificial Sequence
  Description of Artificial Sequence:  Enzymatic Nucleic Acid
  misc_feature (18)..(25): n stands for any nucleotide and can be optionally absent
gcccgcuucugaugaggnnnnnnnnccgaaacgguccg

SEQ ID NO: 6726 - RNA, 38 nt, Artificial Sequence
  Description of Artificial Sequence:  Enzymatic Nucleic Acid
  misc_feature (18)..(25): n stands for any nucleotide and can be optionally absent
uagacaagcugaugaggnnnnnnnnccgaaagccuguc

SEQ ID NO: 6727 - RNA, 38 nt, Artificial Sequence
  Description of Artificial Sequence:  Enzymatic Nucleic Acid
  misc_feature (18)..(25): n stands for any nucleotide and can be optionally absent
caauagaccugaugaggnnnnnnnnccgaaaguagccu

SEQ ID NO: 6728 - RNA, 38 nt, Artificial Sequence
  Description of Artificial Sequence:  Enzymatic Nucleic Acid
  misc_feature (18)..(25): n stands for any nucleotide and can be optionally absent
ugacaauacugaugaggnnnnnnnnccgaaacaaguag

SEQ ID NO: 6729 - RNA, 38 nt, Artificial Sequence
  Description of Artificial Sequence:  Enzymatic Nucleic Acid
  misc_feature (18)..(25): n stands for any nucleotide and can be optionally absent
caugacaacugaugaggnnnnnnnnccgaaagacaagu

SEQ ID NO: 6730 - RNA, 38 nt, Artificial Sequence
  Description of Artificial Sequence:  Enzymatic Nucleic Acid
  misc_feature (18)..(25): n stands for any nucleotide and can be optionally absent
uccaugaccugaugaggnnnnnnnnccgaaauagacaa

SEQ ID NO: 6731 - RNA, 38 nt, Artificial Sequence
  Description of Artificial Sequence:  Enzymatic Nucleic Acid
  misc_feature (18)..(25): n stands for any nucleotide and can be optionally absent
ggauccaucugaugaggnnnnnnnnccgaaacaauaga

SEQ ID NO: 6732 - RNA, 38 nt, Artificial Sequence
  Description of Artificial Sequence:  Enzymatic Nucleic Acid
  misc_feature (18)..(25): n stands for any nucleotide and can be optionally absent
ccaagggccugaugaggnnnnnnnnccgaaauucaucu

SEQ ID NO: 6733 - RNA, 38 nt, Artificial Sequence
  Description of Artificial Sequence:  Enzymatic Nucleic Acid
  misc_feature (18)..(25): n stands for any nucleotide and can be optionally absent
gcucaucccugaugaggnnnnnnnnccgaaagggcaau

SEQ ID NO: 6734 - RNA, 38 nt, Artificial Sequence
  Description of Artificial Sequence:  Enzymatic Nucleic Acid
  misc_feature (18)..(25): n stands for any nucleotide and can be optionally absent
cauaaggccugaugaggnnnnnnnnccgaaagcguuca

SEQ ID NO: 6735 - RNA, 38 nt, Artificial Sequence
  Description of Artificial Sequence:  Enzymatic Nucleic Acid
  misc_feature (18)..(25): n stands for any nucleotide and can be optionally absent
ggcaucaucugaugaggnnnnnnnnccgaaaggcaagc

SEQ ID NO: 6736 - RNA, 38 nt, Artificial Sequence
  Description of Artificial Sequence:  Enzymatic Nucleic Acid
  misc_feature (18)..(25): n stands for any nucleotide and can be optionally absent
uggcaucacugaugaggnnnnnnnnccgaaaaggcaag

SEQ ID NO: 6737 - RNA, 38 nt, Artificial Sequence
  Description of Artificial Sequence:  Enzymatic Nucleic Acid
  misc_feature (18)..(25): n stands for any nucleotide and can be optionally absent
cccuggggcugaugaggnnnnnnnnccgaaauucccac

SEQ ID NO: 6738 - RNA, 38 nt, Artificial Sequence
  Description of Artificial Sequence:  Enzymatic Nucleic Acid
  misc_feature (18)..(25): n stands for any nucleotide and can be optionally absent
ucccugggcugaugaggnnnnnnnnccgaaaauuccca

SEQ ID NO: 6739 - RNA, 38 nt, Artificial Sequence
  Description of Artificial Sequence:  Enzymatic Nucleic Acid
  misc_feature (18)..(25): n stands for any nucleotide and can be optionally absent
gguuuucccugaugaggnnnnnnnnccgaaaguuucag

SEQ ID NO: 6740 - RNA, 38 nt, Artificial Sequence
  Description of Artificial Sequence:  Enzymatic Nucleic Acid
  misc_feature (18)..(25): n stands for any nucleotide and can be optionally absent
gcggccaacugaugaggnnnnnnnnccgaaagguuuuc

SEQ ID NO: 6741 - RNA, 38 nt, Artificial Sequence
  Description of Artificial Sequence:  Enzymatic Nucleic Acid
  misc_feature (18)..(25): n stands for any nucleotide and can be optionally absent
ccgcggcccugaugaggnnnnnnnnccgaaagagguuu

SEQ ID NO: 6742 - RNA, 38 nt, Artificial Sequence
  Description of Artificial Sequence:  Enzymatic Nucleic Acid
  misc_feature (18)..(25): n stands for any nucleotide and can be optionally absent
cuuggccgcugaugaggnnnnnnnnccgaaaggcaccg

SEQ ID NO: 6743 - RNA, 38 nt, Artificial Sequence
  Description of Artificial Sequence:  Enzymatic Nucleic Acid
  misc_feature (18)..(25): n stands for any nucleotide and can be optionally absent
acuuggcccugaugaggnnnnnnnnccgaaaaggcacc

SEQ ID NO: 6744 - RNA, 38 nt, Artificial Sequence
  Description of Artificial Sequence:  Enzymatic Nucleic Acid
  misc_feature (18)..(25): n stands for any nucleotide and can be optionally absent
ucugccuccugaugaggnnnnnnnnccgaaaucacuug

SEQ ID NO: 6745 - RNA, 38 nt, Artificial Sequence
  Description of Artificial Sequence:  Enzymatic Nucleic Acid
  misc_feature (18)..(25): n stands for any nucleotide and can be optionally absent
aauuccaacugaugaggnnnnnnnnccgaaagcgucug

SEQ ID NO: 6746 - RNA, 38 nt, Artificial Sequence
  Description of Artificial Sequence:  Enzymatic Nucleic Acid
  misc_feature (18)..(25): n stands for any nucleotide and can be optionally absent
caauuccacugaugaggnnnnnnnnccgaaaagcgucu

SEQ ID NO: 6747 - RNA, 38 nt, Artificial Sequence
  Description of Artificial Sequence:  Enzymatic Nucleic Acid
  misc_feature (18)..(25): n stands for any nucleotide and can be optionally absent
ucaauucccugaugaggnnnnnnnnccgaaaaagcguc

SEQ ID NO: 6748 - RNA, 38 nt, Artificial Sequence
  Description of Artificial Sequence:  Enzymatic Nucleic Acid
  misc_feature (18)..(25): n stands for any nucleotide and can be optionally absent
uguuuugccugaugaggnnnnnnnnccgaaagucgcug

SEQ ID NO: 6749 - RNA, 38 nt, Artificial Sequence
  Description of Artificial Sequence:  Enzymatic Nucleic Acid
  misc_feature (18)..(25): n stands for any nucleotide and can be optionally absent
uugacggccugaugaggnnnnnnnnccgaaacuguuuu

SEQ ID NO: 6750 - RNA, 38 nt, Artificial Sequence
  Description of Artificial Sequence:  Enzymatic Nucleic Acid
  misc_feature (18)..(25): n stands for any nucleotide and can be optionally absent
aacaucuucugaugaggnnnnnnnnccgaaacggcuac

SEQ ID NO: 6751 - RNA, 38 nt, Artificial Sequence
  Description of Artificial Sequence:  Enzymatic Nucleic Acid
  misc_feature (18)..(25): n stands for any nucleotide and can be optionally absent
cuucuuuccugaugaggnnnnnnnnccgaaacaucuug

SEQ ID NO: 6752 - RNA, 38 nt, Artificial Sequence
  Description of Artificial Sequence:  Enzymatic Nucleic Acid
  misc_feature (18)..(25): n stands for any nucleotide and can be optionally absent
gagggcuccugaugaggnnnnnnnnccgaaaugcucgc

SEQ ID NO: 6753 - RNA, 38 nt, Artificial Sequence
  Description of Artificial Sequence:  Enzymatic Nucleic Acid
  misc_feature (18)..(25): n stands for any nucleotide and can be optionally absent
ucagacaucugaugaggnnnnnnnnccgaaagggcucg

SEQ ID NO: 6754 - RNA, 38 nt, Artificial Sequence
  Description of Artificial Sequence:  Enzymatic Nucleic Acid
  misc_feature (18)..(25): n stands for any nucleotide and can be optionally absent
ugaguucacugaugaggnnnnnnnnccgaaacaugagg

SEQ ID NO: 6755 - RNA, 38 nt, Artificial Sequence
  Description of Artificial Sequence:  Enzymatic Nucleic Acid
  misc_feature (18)..(25): n stands for any nucleotide and can be optionally absent
uggaugagcugaugaggnnnnnnnnccgaaaucuugag

SEQ ID NO: 6756 - RNA, 38 nt, Artificial Sequence
  Description of Artificial Sequence:  Enzymatic Nucleic Acid
  misc_feature (18)..(25): n stands for any nucleotide and can be optionally absent
auguggaucugaugaggnnnnnnnnccgaaaggaucuu

SEQ ID NO: 6757 - RNA, 38 nt, Artificial Sequence
  Description of Artificial Sequence:  Enzymatic Nucleic Acid
  misc_feature (18)..(25): n stands for any nucleotide and can be optionally absent
ccaaugugcugaugaggnnnnnnnnccgaaaugaggau

SEQ ID NO: 6758 - RNA, 38 nt, Artificial Sequence
  Description of Artificial Sequence:  Enzymatic Nucleic Acid
  misc_feature (18)..(25): n stands for any nucleotide and can be optionally absent
uggugacccugaugaggnnnnnnnnccgaaauguggau

SEQ ID NO: 6759 - RNA, 38 nt, Artificial Sequence
  Description of Artificial Sequence:  Enzymatic Nucleic Acid
  misc_feature (18)..(25): n stands for any nucleotide and can be optionally absent
gagauggucugaugaggnnnnnnnnccgaaaccaaugu

SEQ ID NO: 6760 - RNA, 38 nt, Artificial Sequence
  Description of Artificial Sequence:  Enzymatic Nucleic Acid
  misc_feature (18)..(25): n stands for any nucleotide and can be optionally absent
gcgccuagcugaugaggnnnnnnnnccgaaagguucac

SEQ ID NO: 6761 - RNA, 38 nt, Artificial Sequence
  Description of Artificial Sequence:  Enzymatic Nucleic Acid
  misc_feature (18)..(25): n stands for any nucleotide and can be optionally absent
caggcgcccugaugaggnnnnnnnnccgaaaggagguu

SEQ ID NO: 6762 - RNA, 38 nt, Artificial Sequence
  Description of Artificial Sequence:  Enzymatic Nucleic Acid
  misc_feature (18)..(25): n stands for any nucleotide and can be optionally absent
caccaugacugaugaggnnnnnnnnccgaaaggcccuc

SEQ ID NO: 6763 - RNA, 38 nt, Artificial Sequence
  Description of Artificial Sequence:  Enzymatic Nucleic Acid
  misc_feature (18)..(25): n stands for any nucleotide and can be optionally absent
aucaccaucugaugaggnnnnnnnnccgaaagaggccc

SEQ ID NO: 6764 - RNA, 38 nt, Artificial Sequence
  Description of Artificial Sequence:  Enzymatic Nucleic Acid
  misc_feature (18)..(25): n stands for any nucleotide and can be optionally absent
acuugcagcugaugaggnnnnnnnnccgaaauuccaca

SEQ ID NO: 6765 - RNA, 38 nt, Artificial Sequence
  Description of Artificial Sequence:  Enzymatic Nucleic Acid
  misc_feature (18)..(25): n stands for any nucleotide and can be optionally absent
aacuugcacugaugaggnnnnnnnnccgaaaauuccac

SEQ ID NO: 6766 - RNA, 38 nt, Artificial Sequence
  Description of Artificial Sequence:  Enzymatic Nucleic Acid
  misc_feature (18)..(25): n stands for any nucleotide and can be optionally absent
gguuuccacugaugaggnnnnnnnnccgaaacuugcag

SEQ ID NO: 6767 - RNA, 38 nt, Artificial Sequence
  Description of Artificial Sequence:  Enzymatic Nucleic Acid
  misc_feature (18)..(25): n stands for any nucleotide and can be optionally absent
agguuucccugaugaggnnnnnnnnccgaaaacuugca

SEQ ID NO: 6768 - RNA, 38 nt, Artificial Sequence
  Description of Artificial Sequence:  Enzymatic Nucleic Acid
  misc_feature (18)..(25): n stands for any nucleotide and can be optionally absent
uaaguugacugaugaggnnnnnnnnccgaaagguuucc

SEQ ID NO: 6769 - RNA, 38 nt, Artificial Sequence
  Description of Artificial Sequence:  Enzymatic Nucleic Acid
  misc_feature (18)..(25): n stands for any nucleotide and can be optionally absent
aguaaguucugaugaggnnnnnnnnccgaaauagguuu

SEQ ID NO: 6770 - RNA, 38 nt, Artificial Sequence
  Description of Artificial Sequence:  Enzymatic Nucleic Acid
  misc_feature (18)..(25): n stands for any nucleotide and can be optionally absent
ccguaagucugaugaggnnnnnnnnccgaaaguugaua

SEQ ID NO: 6771 - RNA, 38 nt, Artificial Sequence
  Description of Artificial Sequence:  Enzymatic Nucleic Acid
  misc_feature (18)..(25): n stands for any nucleotide and can be optionally absent
cccguaagcugaugaggnnnnnnnnccgaaaaguugau

SEQ ID NO: 6772 - RNA, 38 nt, Artificial Sequence
  Description of Artificial Sequence:  Enzymatic Nucleic Acid
  misc_feature (18)..(25): n stands for any nucleotide and can be optionally absent
ugccccgucugaugaggnnnnnnnnccgaaaguaaguu

SEQ ID NO: 6773 - RNA, 38 nt, Artificial Sequence
  Description of Artificial Sequence:  Enzymatic Nucleic Acid
  misc_feature (18)..(25): n stands for any nucleotide and can be optionally absent
uugccccgcugaugaggnnnnnnnnccgaaaaguaagu

SEQ ID NO: 6774 - RNA, 38 nt, Artificial Sequence
  Description of Artificial Sequence:  Enzymatic Nucleic Acid
  misc_feature (18)..(25): n stands for any nucleotide and can be optionally absent
agggaacacugaugaggnnnnnnnnccgaaauucauuu

SEQ ID NO: 6775 - RNA, 38 nt, Artificial Sequence
  Description of Artificial Sequence:  Enzymatic Nucleic Acid
  misc_feature (18)..(25): n stands for any nucleotide and can be optionally absent
uagggaaccugaugaggnnnnnnnnccgaaaauucauu

SEQ ID NO: 6776 - RNA, 38 nt, Artificial Sequence
  Description of Artificial Sequence:  Enzymatic Nucleic Acid
  misc_feature (18)..(25): n stands for any nucleotide and can be optionally absent
uuauagggcugaugaggnnnnnnnnccgaaacaaauuc

SEQ ID NO: 6777 - RNA, 38 nt, Artificial Sequence
  Description of Artificial Sequence:  Enzymatic Nucleic Acid
  misc_feature (18)..(25): n stands for any nucleotide and can be optionally absent
cuuauaggcugaugaggnnnnnnnnccgaaaacaaauu

SEQ ID NO: 6778 - RNA, 38 nt, Artificial Sequence
  Description of Artificial Sequence:  Enzymatic Nucleic Acid
  misc_feature (18)..(25): n stands for any nucleotide and can be optionally absent
ugcucuuacugaugaggnnnnnnnnccgaaagggaaca

SEQ ID NO: 6779 - RNA, 38 nt, Artificial Sequence
  Description of Artificial Sequence:  Enzymatic Nucleic Acid
  misc_feature (18)..(25): n stands for any nucleotide and can be optionally absent
uuugcucucugaugaggnnnnnnnnccgaaauagggaa

SEQ ID NO: 6780 - RNA, 38 nt, Artificial Sequence
  Description of Artificial Sequence:  Enzymatic Nucleic Acid
  misc_feature (18)..(25): n stands for any nucleotide and can be optionally absent
ccuggcggcugaugaggnnnnnnnnccgaaagcgugcc

SEQ ID NO: 6781 - RNA, 38 nt, Artificial Sequence
  Description of Artificial Sequence:  Enzymatic Nucleic Acid
  misc_feature (18)..(25): n stands for any nucleotide and can be optionally absent
cccuggcgcugaugaggnnnnnnnnccgaaaagcgugc

SEQ ID NO: 6782 - RNA, 38 nt, Artificial Sequence
  Description of Artificial Sequence:  Enzymatic Nucleic Acid
  misc_feature (18)..(25): n stands for any nucleotide and can be optionally absent
ccccaacgcugaugaggnnnnnnnnccgaaaguccuug

SEQ ID NO: 6783 - RNA, 38 nt, Artificial Sequence
  Description of Artificial Sequence:  Enzymatic Nucleic Acid
  misc_feature (18)..(25): n stands for any nucleotide and can be optionally absent
agcucccccugaugaggnnnnnnnnccgaaacguaguc

SEQ ID NO: 6784 - RNA, 38 nt, Artificial Sequence
  Description of Artificial Sequence:  Enzymatic Nucleic Acid
  misc_feature (18)..(25): n stands for any nucleotide and can be optionally absent
uccacggacugaugaggnnnnnnnnccgaaagcucccc

SEQ ID NO: 6785 - RNA, 38 nt, Artificial Sequence
  Description of Artificial Sequence:  Enzymatic Nucleic Acid
  misc_feature (18)..(25): n stands for any nucleotide and can be optionally absent
gauccacgcugaugaggnnnnnnnnccgaaagagcucc

SEQ ID NO: 6786 - RNA, 38 nt, Artificial Sequence
  Description of Artificial Sequence:  Enzymatic Nucleic Acid
  misc_feature (18)..(25): n stands for any nucleotide and can be optionally absent
ucuuuucacugaugaggnnnnnnnnccgaaauccacgg

SEQ ID NO: 6787 - RNA, 38 nt, Artificial Sequence
  Description of Artificial Sequence:  Enzymatic Nucleic Acid
  misc_feature (18)..(25): n stands for any nucleotide and can be optionally absent
ugcugucccugaugaggnnnnnnnnccgaaagcgucuu

SEQ ID NO: 6788 - RNA, 38 nt, Artificial Sequence
  Description of Artificial Sequence:  Enzymatic Nucleic Acid
  misc_feature (18)..(25): n stands for any nucleotide and can be optionally absent
cugcuggucugaugaggnnnnnnnnccgaaaugcuguc

SEQ ID NO: 6789 - RNA, 38 nt, Artificial Sequence
  Description of Artificial Sequence:  Enzymatic Nucleic Acid
  misc_feature (18)..(25): n stands for any nucleotide and can be optionally absent
agcuggcacugaugaggnnnnnnnnccgaaagcucugg

SEQ ID NO: 6790 - RNA, 38 nt, Artificial Sequence
  Description of Artificial Sequence:  Enzymatic Nucleic Acid
  misc_feature (18)..(25): n stands for any nucleotide and can be optionally absent
caaagccucugaugaggnnnnnnnnccgaaagcuggca

SEQ ID NO: 6791 - RNA, 38 nt, Artificial Sequence
  Description of Artificial Sequence:  Enzymatic Nucleic Acid
  misc_feature (18)..(25): n stands for any nucleotide and can be optionally absent
ccucaacacugaugaggnnnnnnnnccgaaagccugag

SEQ ID NO: 6792 - RNA, 38 nt, Artificial Sequence
  Description of Artificial Sequence:  Enzymatic Nucleic Acid
  misc_feature (18)..(25): n stands for any nucleotide and can be optionally absent
uccucaaccugaugaggnnnnnnnnccgaaaagccuga

SEQ ID NO: 6793 - RNA, 38 nt, Artificial Sequence
  Description of Artificial Sequence:  Enzymatic Nucleic Acid
  misc_feature (18)..(25): n stands for any nucleotide and can be optionally absent
uucuccuccugaugaggnnnnnnnnccgaaacaaagcc

SEQ ID NO: 6794 - RNA, 38 nt, Artificial Sequence
  Description of Artificial Sequence:  Enzymatic Nucleic Acid
  misc_feature (18)..(25): n stands for any nucleotide and can be optionally absent
cacugagccugaugaggnnnnnnnnccgaaauuucucc

SEQ ID NO: 6795 - RNA, 38 nt, Artificial Sequence
  Description of Artificial Sequence:  Enzymatic Nucleic Acid
  misc_feature (18)..(25): n stands for any nucleotide and can be optionally absent
acaucacucugaugaggnnnnnnnnccgaaagcgauuu

SEQ ID NO: 6796 - RNA, 38 nt, Artificial Sequence
  Description of Artificial Sequence:  Enzymatic Nucleic Acid
  misc_feature (18)..(25): n stands for any nucleotide and can be optionally absent
uucuucagcugaugaggnnnnnnnnccgaaagcuucuu

SEQ ID NO: 6797 - RNA, 38 nt, Artificial Sequence
  Description of Artificial Sequence:  Enzymatic Nucleic Acid
  misc_feature (18)..(25): n stands for any nucleotide and can be optionally absent
guucuucacugaugaggnnnnnnnnccgaaaagcuucu

SEQ ID NO: 6798 - RNA, 38 nt, Artificial Sequence
  Description of Artificial Sequence:  Enzymatic Nucleic Acid
  misc_feature (18)..(25): n stands for any nucleotide and can be optionally absent
aguccuugcugaugaggnnnnnnnnccgaaacaguucu

SEQ ID NO: 6799 - RNA, 38 nt, Artificial Sequence
  Description of Artificial Sequence:  Enzymatic Nucleic Acid
  misc_feature (18)..(25): n stands for any nucleotide and can be optionally absent
aggucaggcugaugaggnnnnnnnnccgaaaguccuug

SEQ ID NO: 6800 - RNA, 38 nt, Artificial Sequence
  Description of Artificial Sequence:  Enzymatic Nucleic Acid
  misc_feature (18)..(25): n stands for any nucleotide and can be optionally absent
uugaugcccugaugaggnnnnnnnnccgaaagaacucc

SEQ ID NO: 6801 - RNA, 38 nt, Artificial Sequence
  Description of Artificial Sequence:  Enzymatic Nucleic Acid
  misc_feature (18)..(25): n stands for any nucleotide and can be optionally absent
acuuccuucugaugaggnnnnnnnnccgaaaugccaag

SEQ ID NO: 6802 - RNA, 38 nt, Artificial Sequence
  Description of Artificial Sequence:  Enzymatic Nucleic Acid
  misc_feature (18)..(25): n stands for any nucleotide and can be optionally absent
ccuguggacugaugaggnnnnnnnnccgaaacacuucc

SEQ ID NO: 6803 - RNA, 38 nt, Artificial Sequence
  Description of Artificial Sequence:  Enzymatic Nucleic Acid
  misc_feature (18)..(25): n stands for any nucleotide and can be optionally absent
gauaggagcugaugaggnnnnnnnnccgaaauguuucg

SEQ ID NO: 6804 - RNA, 38 nt, Artificial Sequence
  Description of Artificial Sequence:  Enzymatic Nucleic Acid
  misc_feature (18)..(25): n stands for any nucleotide and can be optionally absent
cgauaggacugaugaggnnnnnnnnccgaaaauguuuc

SEQ ID NO: 6805 - RNA, 38 nt, Artificial Sequence
  Description of Artificial Sequence:  Enzymatic Nucleic Acid
  misc_feature (18)..(25): n stands for any nucleotide and can be optionally absent
uccgauagcugaugaggnnnnnnnnccgaaagaauguu

SEQ ID NO: 6806 - RNA, 38 nt, Artificial Sequence
  Description of Artificial Sequence:  Enzymatic Nucleic Acid
  misc_feature (18)..(25): n stands for any nucleotide and can be optionally absent
uucuccgacugaugaggnnnnnnnnccgaaaggagaau

SEQ ID NO: 6807 - RNA, 38 nt, Artificial Sequence
  Description of Artificial Sequence:  Enzymatic Nucleic Acid
  misc_feature (18)..(25): n stands for any nucleotide and can be optionally absent
ucuucucccugaugaggnnnnnnnnccgaaauaggaga

SEQ ID NO: 6808 - RNA, 38 nt, Artificial Sequence
  Description of Artificial Sequence:  Enzymatic Nucleic Acid
  misc_feature (18)..(25): n stands for any nucleotide and can be optionally absent
cagaucuucugaugaggnnnnnnnnccgaaaccacauu

SEQ ID NO: 6809 - RNA, 38 nt, Artificial Sequence
  Description of Artificial Sequence:  Enzymatic Nucleic Acid
  misc_feature (18)..(25): n stands for any nucleotide and can be optionally absent
acagaucucugaugaggnnnnnnnnccgaaaaccacau

SEQ ID NO: 6810 - RNA, 38 nt, Artificial Sequence
  Description of Artificial Sequence:  Enzymatic Nucleic Acid
  misc_feature (18)..(25): n stands for any nucleotide and can be optionally absent
aagucacacugaugaggnnnnnnnnccgaaaucuuaac

SEQ ID NO: 6811 - RNA, 38 nt, Artificial Sequence
  Description of Artificial Sequence:  Enzymatic Nucleic Acid
  misc_feature (18)..(25): n stands for any nucleotide and can be optionally absent
ccaagccgcugaugaggnnnnnnnnccgaaagucacag

SEQ ID NO: 6812 - RNA, 38 nt, Artificial Sequence
  Description of Artificial Sequence:  Enzymatic Nucleic Acid
  misc_feature (18)..(25): n stands for any nucleotide and can be optionally absent
cccgggcccugaugaggnnnnnnnnccgaaagccgaag

SEQ ID NO: 6813 - RNA, 38 nt, Artificial Sequence
  Description of Artificial Sequence:  Enzymatic Nucleic Acid
  misc_feature (18)..(25): n stands for any nucleotide and can be optionally absent
ucuuuauacugaugaggnnnnnnnnccgaaaugucccg

SEQ ID NO: 6814 - RNA, 38 nt, Artificial Sequence
  Description of Artificial Sequence:  Enzymatic Nucleic Acid
  misc_feature (18)..(25): n stands for any nucleotide and can be optionally absent
gucuuuaucugaugaggnnnnnnnnccgaaaauguccc

SEQ ID NO: 6815 - RNA, 38 nt, Artificial Sequence
  Description of Artificial Sequence:  Enzymatic Nucleic Acid
  misc_feature (18)..(25): n stands for any nucleotide and can be optionally absent
ggucuuuacugaugaggnnnnnnnnccgaaaaaugucc

SEQ ID NO: 6816 - RNA, 38 nt, Artificial Sequence
  Description of Artificial Sequence:  Enzymatic Nucleic Acid
  misc_feature (18)..(25): n stands for any nucleotide and can be optionally absent
cgggucuucugaugaggnnnnnnnnccgaaauaaaugu

SEQ ID NO: 6817 - RNA, 38 nt, Artificial Sequence
  Description of Artificial Sequence:  Enzymatic Nucleic Acid
  misc_feature (18)..(25): n stands for any nucleotide and can be optionally absent
ucugacaucugaugaggnnnnnnnnccgaaauccgggu

SEQ ID NO: 6818 - RNA, 38 nt, Artificial Sequence
  Description of Artificial Sequence:  Enzymatic Nucleic Acid
  misc_feature (18)..(25): n stands for any nucleotide and can be optionally absent
uucugacacugaugaggnnnnnnnnccgaaaauccggg

SEQ ID NO: 6819 - RNA, 38 nt, Artificial Sequence
  Description of Artificial Sequence:  Enzymatic Nucleic Acid
  misc_feature (18)..(25): n stands for any nucleotide and can be optionally absent
uucaaaggcugaugaggnnnnnnnnccgaaagucgggc

SEQ ID NO: 6820 - RNA, 38 nt, Artificial Sequence
  Description of Artificial Sequence:  Enzymatic Nucleic Acid
  misc_feature (18)..(25): n stands for any nucleotide and can be optionally absent
ccacuucacugaugaggnnnnnnnnccgaaagggaguc

SEQ ID NO: 6821 - RNA, 38 nt, Artificial Sequence
  Description of Artificial Sequence:  Enzymatic Nucleic Acid
  misc_feature (18)..(25): n stands for any nucleotide and can be optionally absent
uccacuuccugaugaggnnnnnnnnccgaaaagggagu

SEQ ID NO: 6822 - RNA, 38 nt, Artificial Sequence
  Description of Artificial Sequence:  Enzymatic Nucleic Acid
  misc_feature (18)..(25): n stands for any nucleotide and can be optionally absent
cugucaaacugaugaggnnnnnnnnccgaaaugguuuc

SEQ ID NO: 6823 - RNA, 38 nt, Artificial Sequence
  Description of Artificial Sequence:  Enzymatic Nucleic Acid
  misc_feature (18)..(25): n stands for any nucleotide and can be optionally absent
ucugucaacugaugaggnnnnnnnnccgaaaaugguuu

SEQ ID NO: 6824 - RNA, 38 nt, Artificial Sequence
  Description of Artificial Sequence:  Enzymatic Nucleic Acid
  misc_feature (18)..(25): n stands for any nucleotide and can be optionally absent
cucugucacugaugaggnnnnnnnnccgaaaaaugguu

SEQ ID NO: 6825 - RNA, 38 nt, Artificial Sequence
  Description of Artificial Sequence:  Enzymatic Nucleic Acid
  misc_feature (18)..(25): n stands for any nucleotide and can be optionally absent
acucuguccugaugaggnnnnnnnnccgaaaaaauggu

SEQ ID NO: 6826 - RNA, 38 nt, Artificial Sequence
  Description of Artificial Sequence:  Enzymatic Nucleic Acid
  misc_feature (18)..(25): n stands for any nucleotide and can be optionally absent
auuguguacugaugaggnnnnnnnnccgaaacucuguc

SEQ ID NO: 6827 - RNA, 38 nt, Artificial Sequence
  Description of Artificial Sequence:  Enzymatic Nucleic Acid
  misc_feature (18)..(25): n stands for any nucleotide and can be optionally absent
gaauugugcugaugaggnnnnnnnnccgaaauacucug

SEQ ID NO: 6828 - RNA, 38 nt, Artificial Sequence
  Description of Artificial Sequence:  Enzymatic Nucleic Acid
  misc_feature (18)..(25): n stands for any nucleotide and can be optionally absent
ucgcucugcugaugaggnnnnnnnnccgaaauugugua

SEQ ID NO: 6829 - RNA, 38 nt, Artificial Sequence
  Description of Artificial Sequence:  Enzymatic Nucleic Acid
  misc_feature (18)..(25): n stands for any nucleotide and can be optionally absent
aucgcucucugaugaggnnnnnnnnccgaaaauugugu

SEQ ID NO: 6830 - RNA, 38 nt, Artificial Sequence
  Description of Artificial Sequence:  Enzymatic Nucleic Acid
  misc_feature (18)..(25): n stands for any nucleotide and can be optionally absent
caccgaaacugaugaggnnnnnnnnccgaaaccacaca

SEQ ID NO: 6831 - RNA, 38 nt, Artificial Sequence
  Description of Artificial Sequence:  Enzymatic Nucleic Acid
  misc_feature (18)..(25): n stands for any nucleotide and can be optionally absent
cacaccgacugaugaggnnnnnnnnccgaaagaccaca

SEQ ID NO: 6832 - RNA, 38 nt, Artificial Sequence
  Description of Artificial Sequence:  Enzymatic Nucleic Acid
  misc_feature (18)..(25): n stands for any nucleotide and can be optionally absent
acacaccgcugaugaggnnnnnnnnccgaaaagaccac

SEQ ID NO: 6833 - RNA, 38 nt, Artificial Sequence
  Description of Artificial Sequence:  Enzymatic Nucleic Acid
  misc_feature (18)..(25): n stands for any nucleotide and can be optionally absent
aacacacccugaugaggnnnnnnnnccgaaaaagacca

SEQ ID NO: 6834 - RNA, 38 nt, Artificial Sequence
  Description of Artificial Sequence:  Enzymatic Nucleic Acid
  misc_feature (18)..(25): n stands for any nucleotide and can be optionally absent
cccagagccugaugaggnnnnnnnnccgaaacacaccg

SEQ ID NO: 6835 - RNA, 38 nt, Artificial Sequence
  Description of Artificial Sequence:  Enzymatic Nucleic Acid
  misc_feature (18)..(25): n stands for any nucleotide and can be optionally absent
auuucccacugaugaggnnnnnnnnccgaaagcaacac

SEQ ID NO: 6836 - RNA, 38 nt, Artificial Sequence
  Description of Artificial Sequence:  Enzymatic Nucleic Acid
  misc_feature (18)..(25): n stands for any nucleotide and can be optionally absent
aggcaccucugaugaggnnnnnnnnccgaaaggaaaau

SEQ ID NO: 6837 - RNA, 38 nt, Artificial Sequence
  Description of Artificial Sequence:  Enzymatic Nucleic Acid
  misc_feature (18)..(25): n stands for any nucleotide and can be optionally absent
gaggcacccugaugaggnnnnnnnnccgaaaaggaaaa

SEQ ID NO: 6838 - RNA, 38 nt, Artificial Sequence
  Description of Artificial Sequence:  Enzymatic Nucleic Acid
  misc_feature (18)..(25): n stands for any nucleotide and can be optionally absent
gguaugggcugaugaggnnnnnnnnccgaaaggcaccu

SEQ ID NO: 6839 - RNA, 38 nt, Artificial Sequence
  Description of Artificial Sequence:  Enzymatic Nucleic Acid
  misc_feature (18)..(25): n stands for any nucleotide and can be optionally absent
ccccagggcugaugaggnnnnnnnnccgaaauggggag

SEQ ID NO: 6840 - RNA, 38 nt, Artificial Sequence
  Description of Artificial Sequence:  Enzymatic Nucleic Acid
  misc_feature (18)..(25): n stands for any nucleotide and can be optionally absent
ucuucauccugaugaggnnnnnnnnccgaaaucuugac

SEQ ID NO: 6841 - RNA, 38 nt, Artificial Sequence
  Description of Artificial Sequence:  Enzymatic Nucleic Acid
  misc_feature (18)..(25): n stands for any nucleotide and can be optionally absent
uccuacaacugaugaggnnnnnnnnccgaaauucuuca

SEQ ID NO: 6842 - RNA, 38 nt, Artificial Sequence
  Description of Artificial Sequence:  Enzymatic Nucleic Acid
  misc_feature (18)..(25): n stands for any nucleotide and can be optionally absent
cuccuacacugaugaggnnnnnnnnccgaaaauucuuc

SEQ ID NO: 6843 - RNA, 38 nt, Artificial Sequence
  Description of Artificial Sequence:  Enzymatic Nucleic Acid
  misc_feature (18)..(25): n stands for any nucleotide and can be optionally absent
ucuccuaccugaugaggnnnnnnnnccgaaaaauucuu

SEQ ID NO: 6844 - RNA, 38 nt, Artificial Sequence
  Description of Artificial Sequence:  Enzymatic Nucleic Acid
  misc_feature (18)..(25): n stands for any nucleotide and can be optionally absent
caaucucccugaugaggnnnnnnnnccgaaacaaaauu

SEQ ID NO: 6845 - RNA, 38 nt, Artificial Sequence
  Description of Artificial Sequence:  Enzymatic Nucleic Acid
  misc_feature (18)..(25): n stands for any nucleotide and can be optionally absent
cuucuuuccugaugaggnnnnnnnnccgaaaucuccua

SEQ ID NO: 6846 - RNA, 38 nt, Artificial Sequence
  Description of Artificial Sequence:  Enzymatic Nucleic Acid
  misc_feature (18)..(25): n stands for any nucleotide and can be optionally absent
ccgcauuccugaugaggnnnnnnnnccgaaaguuccuu

SEQ ID NO: 6847 - RNA, 38 nt, Artificial Sequence
  Description of Artificial Sequence:  Enzymatic Nucleic Acid
  misc_feature (18)..(25): n stands for any nucleotide and can be optionally absent
guagucagcugaugaggnnnnnnnnccgaaagcccgca

SEQ ID NO: 6848 - RNA, 38 nt, Artificial Sequence
  Description of Artificial Sequence:  Enzymatic Nucleic Acid
  misc_feature (18)..(25): n stands for any nucleotide and can be optionally absent
ggguagugcugaugaggnnnnnnnnccgaaagucagga

SEQ ID NO: 6849 - RNA, 38 nt, Artificial Sequence
  Description of Artificial Sequence:  Enzymatic Nucleic Acid
  misc_feature (18)..(25): n stands for any nucleotide and can be optionally absent
uucuggggcugaugaggnnnnnnnnccgaaaguguagu

SEQ ID NO: 6850 - RNA, 38 nt, Artificial Sequence
  Description of Artificial Sequence:  Enzymatic Nucleic Acid
  misc_feature (18)..(25): n stands for any nucleotide and can be optionally absent
cugaaaaccugaugaggnnnnnnnnccgaaagggucuc

SEQ ID NO: 6851 - RNA, 38 nt, Artificial Sequence
  Description of Artificial Sequence:  Enzymatic Nucleic Acid
  misc_feature (18)..(25): n stands for any nucleotide and can be optionally absent
acucugaacugaugaggnnnnnnnnccgaaacgagggu

SEQ ID NO: 6852 - RNA, 38 nt, Artificial Sequence
  Description of Artificial Sequence:  Enzymatic Nucleic Acid
  misc_feature (18)..(25): n stands for any nucleotide and can be optionally absent
aacucugacugaugaggnnnnnnnnccgaaaacgaggg

SEQ ID NO: 6853 - RNA, 38 nt, Artificial Sequence
  Description of Artificial Sequence:  Enzymatic Nucleic Acid
  misc_feature (18)..(25): n stands for any nucleotide and can be optionally absent
caacucugcugaugaggnnnnnnnnccgaaaaacgagg

SEQ ID NO: 6854 - RNA, 38 nt, Artificial Sequence
  Description of Artificial Sequence:  Enzymatic Nucleic Acid
  misc_feature (18)..(25): n stands for any nucleotide and can be optionally absent
ccaacucucugaugaggnnnnnnnnccgaaaaaacgag

SEQ ID NO: 6855 - RNA, 38 nt, Artificial Sequence
  Description of Artificial Sequence:  Enzymatic Nucleic Acid
  misc_feature (18)..(25): n stands for any nucleotide and can be optionally absent
gcuccacccugaugaggnnnnnnnnccgaaacucugaa

SEQ ID NO: 6856 - RNA, 38 nt, Artificial Sequence
  Description of Artificial Sequence:  Enzymatic Nucleic Acid
  misc_feature (18)..(25): n stands for any nucleotide and can be optionally absent
guuucccacugaugaggnnnnnnnnccgaaaugcucca

SEQ ID NO: 6857 - RNA, 38 nt, Artificial Sequence
  Description of Artificial Sequence:  Enzymatic Nucleic Acid
  misc_feature (18)..(25): n stands for any nucleotide and can be optionally absent
gguuuccccugaugaggnnnnnnnnccgaaaaugcucc

SEQ ID NO: 6858 - RNA, 38 nt, Artificial Sequence
  Description of Artificial Sequence:  Enzymatic Nucleic Acid
  misc_feature (18)..(25): n stands for any nucleotide and can be optionally absent
gcuugcagcugaugaggnnnnnnnnccgaaagguuucc

SEQ ID NO: 6859 - RNA, 38 nt, Artificial Sequence
  Description of Artificial Sequence:  Enzymatic Nucleic Acid
  misc_feature (18)..(25): n stands for any nucleotide and can be optionally absent
gaacaauacugaugaggnnnnnnnnccgaaagucuuug

SEQ ID NO: 6860 - RNA, 38 nt, Artificial Sequence
  Description of Artificial Sequence:  Enzymatic Nucleic Acid
  misc_feature (18)..(25): n stands for any nucleotide and can be optionally absent
aagaacaacugaugaggnnnnnnnnccgaaauagucuu

SEQ ID NO: 6861 - RNA, 38 nt, Artificial Sequence
  Description of Artificial Sequence:  Enzymatic Nucleic Acid
  misc_feature (18)..(25): n stands for any nucleotide and can be optionally absent
ggaagaaccugaugaggnnnnnnnnccgaaauauaguc

SEQ ID NO: 6862 - RNA, 38 nt, Artificial Sequence
  Description of Artificial Sequence:  Enzymatic Nucleic Acid
  misc_feature (18)..(25): n stands for any nucleotide and can be optionally absent
auuggaagcugaugaggnnnnnnnnccgaaacaauaua

SEQ ID NO: 6863 - RNA, 38 nt, Artificial Sequence
  Description of Artificial Sequence:  Enzymatic Nucleic Acid
  misc_feature (18)..(25): n stands for any nucleotide and can be optionally absent
cauuggaacugaugaggnnnnnnnnccgaaaacaauau

SEQ ID NO: 6864 - RNA, 38 nt, Artificial Sequence
  Description of Artificial Sequence:  Enzymatic Nucleic Acid
  misc_feature (18)..(25): n stands for any nucleotide and can be optionally absent
gacauuggcugaugaggnnnnnnnnccgaaagaacaau

SEQ ID NO: 6865 - RNA, 38 nt, Artificial Sequence
  Description of Artificial Sequence:  Enzymatic Nucleic Acid
  misc_feature (18)..(25): n stands for any nucleotide and can be optionally absent
ugacauugcugaugaggnnnnnnnnccgaaaagaacaa

SEQ ID NO: 6866 - RNA, 38 nt, Artificial Sequence
  Description of Artificial Sequence:  Enzymatic Nucleic Acid
  misc_feature (18)..(25): n stands for any nucleotide and can be optionally absent
gugucucucugaugaggnnnnnnnnccgaaacauugga

SEQ ID NO: 6867 - RNA, 38 nt, Artificial Sequence
  Description of Artificial Sequence:  Enzymatic Nucleic Acid
  misc_feature (18)..(25): n stands for any nucleotide and can be optionally absent
ggcagggacugaugaggnnnnnnnnccgaaaguccaga

SEQ ID NO: 6868 - RNA, 38 nt, Artificial Sequence
  Description of Artificial Sequence:  Enzymatic Nucleic Acid
  misc_feature (18)..(25): n stands for any nucleotide and can be optionally absent
uaggcaggcugaugaggnnnnnnnnccgaaagagucca

SEQ ID NO: 6869 - RNA, 38 nt, Artificial Sequence
  Description of Artificial Sequence:  Enzymatic Nucleic Acid
  misc_feature (18)..(25): n stands for any nucleotide and can be optionally absent
aggugaggcugaugaggnnnnnnnnccgaaaggcaggg

SEQ ID NO: 6870 - RNA, 38 nt, Artificial Sequence
  Description of Artificial Sequence:  Enzymatic Nucleic Acid
  misc_feature (18)..(25): n stands for any nucleotide and can be optionally absent
uuccuccacugaugaggnnnnnnnnccgaaacaggaaa

SEQ ID NO: 6871 - RNA, 38 nt, Artificial Sequence
  Description of Artificial Sequence:  Enzymatic Nucleic Acid
  misc_feature (18)..(25): n stands for any nucleotide and can be optionally absent
uaaugacucugaugaggnnnnnnnnccgaaauuccugc

SEQ ID NO: 6872 - RNA, 38 nt, Artificial Sequence
  Description of Artificial Sequence:  Enzymatic Nucleic Acid
  misc_feature (18)..(25): n stands for any nucleotide and can be optionally absent
gagauaaucugaugaggnnnnnnnnccgaaacugauuc

SEQ ID NO: 6873 - RNA, 38 nt, Artificial Sequence
  Description of Artificial Sequence:  Enzymatic Nucleic Acid
  misc_feature (18)..(25): n stands for any nucleotide and can be optionally absent
cuggagaucugaugaggnnnnnnnnccgaaaugacuga

SEQ ID NO: 6874 - RNA, 38 nt, Artificial Sequence
  Description of Artificial Sequence:  Enzymatic Nucleic Acid
  misc_feature (18)..(25): n stands for any nucleotide and can be optionally absent
ucuggagacugaugaggnnnnnnnnccgaaaaugacug

SEQ ID NO: 6875 - RNA, 38 nt, Artificial Sequence
  Description of Artificial Sequence:  Enzymatic Nucleic Acid
  misc_feature (18)..(25): n stands for any nucleotide and can be optionally absent
guucuggacugaugaggnnnnnnnnccgaaauaaugac

SEQ ID NO: 6876 - RNA, 38 nt, Artificial Sequence
  Description of Artificial Sequence:  Enzymatic Nucleic Acid
  misc_feature (18)..(25): n stands for any nucleotide and can be optionally absent
cuguucugcugaugaggnnnnnnnnccgaaagauaaug

SEQ ID NO: 6877 - RNA, 38 nt, Artificial Sequence
  Description of Artificial Sequence:  Enzymatic Nucleic Acid
  misc_feature (18)..(25): n stands for any nucleotide and can be optionally absent
caaugggacugaugaggnnnnnnnnccgaaaucuucaa

SEQ ID NO: 6878 - RNA, 38 nt, Artificial Sequence
  Description of Artificial Sequence:  Enzymatic Nucleic Acid
  misc_feature (18)..(25): n stands for any nucleotide and can be optionally absent
uccaauggcugaugaggnnnnnnnnccgaaauaucuuc

SEQ ID NO: 6879 - RNA, 38 nt, Artificial Sequence
  Description of Artificial Sequence:  Enzymatic Nucleic Acid
  misc_feature (18)..(25): n stands for any nucleotide and can be optionally absent
guuccucccugaugaggnnnnnnnnccgaaaugggaua

SEQ ID NO: 6880 - RNA, 38 nt, Artificial Sequence
  Description of Artificial Sequence:  Enzymatic Nucleic Acid
  misc_feature (18)..(25): n stands for any nucleotide and can be optionally absent
aucacuuucugaugaggnnnnnnnnccgaaacuucugg

SEQ ID NO: 6881 - RNA, 38 nt, Artificial Sequence
  Description of Artificial Sequence:  Enzymatic Nucleic Acid
  misc_feature (18)..(25): n stands for any nucleotide and can be optionally absent
ucaucuggcugaugaggnnnnnnnnccgaaaucacuuu

SEQ ID NO: 6882 - RNA, 38 nt, Artificial Sequence
  Description of Artificial Sequence:  Enzymatic Nucleic Acid
  misc_feature (18)..(25): n stands for any nucleotide and can be optionally absent
gaugcaagcugaugaggnnnnnnnnccgaaaccauccc

SEQ ID NO: 6883 - RNA, 38 nt, Artificial Sequence
  Description of Artificial Sequence:  Enzymatic Nucleic Acid
  misc_feature (18)..(25): n stands for any nucleotide and can be optionally absent
ucugaugccugaugaggnnnnnnnnccgaaaggaccau

SEQ ID NO: 6884 - RNA, 38 nt, Artificial Sequence
  Description of Artificial Sequence:  Enzymatic Nucleic Acid
  misc_feature (18)..(25): n stands for any nucleotide and can be optionally absent
gcucuucucugaugaggnnnnnnnnccgaaaugcaagg

SEQ ID NO: 6885 - RNA, 38 nt, Artificial Sequence
  Description of Artificial Sequence:  Enzymatic Nucleic Acid
  misc_feature (18)..(25): n stands for any nucleotide and can be optionally absent
auggagaucugaugaggnnnnnnnnccgaaauuuguuc

SEQ ID NO: 6886 - RNA, 38 nt, Artificial Sequence
  Description of Artificial Sequence:  Enzymatic Nucleic Acid
  misc_feature (18)..(25): n stands for any nucleotide and can be optionally absent
gauggagacugaugaggnnnnnnnnccgaaaauuuguu

SEQ ID NO: 6887 - RNA, 38 nt, Artificial Sequence
  Description of Artificial Sequence:  Enzymatic Nucleic Acid
  misc_feature (18)..(25): n stands for any nucleotide and can be optionally absent
ccugcuuucugaugaggnnnnnnnnccgaaacugggca

SEQ ID NO: 6888 - RNA, 38 nt, Artificial Sequence
  Description of Artificial Sequence:  Enzymatic Nucleic Acid
  misc_feature (18)..(25): n stands for any nucleotide and can be optionally absent
aggccacacugaugaggnnnnnnnnccgaaacucccug

SEQ ID NO: 6889 - RNA, 38 nt, Artificial Sequence
  Description of Artificial Sequence:  Enzymatic Nucleic Acid
  misc_feature (18)..(25): n stands for any nucleotide and can be optionally absent
agccuucccugaugaggnnnnnnnnccgaaaggccaca

SEQ ID NO: 6890 - RNA, 38 nt, Artificial Sequence
  Description of Artificial Sequence:  Enzymatic Nucleic Acid
  misc_feature (18)..(25): n stands for any nucleotide and can be optionally absent
ucugguugcugaugaggnnnnnnnnccgaaagccuucc

SEQ ID NO: 6891 - RNA, 38 nt, Artificial Sequence
  Description of Artificial Sequence:  Enzymatic Nucleic Acid
  misc_feature (18)..(25): n stands for any nucleotide and can be optionally absent
cagacuggcugaugaggnnnnnnnnccgaaagccacug

SEQ ID NO: 6892 - RNA, 38 nt, Artificial Sequence
  Description of Artificial Sequence:  Enzymatic Nucleic Acid
  misc_feature (18)..(25): n stands for any nucleotide and can be optionally absent
gauacccacugaugaggnnnnnnnnccgaaacugguag

SEQ ID NO: 6893 - RNA, 38 nt, Artificial Sequence
  Description of Artificial Sequence:  Enzymatic Nucleic Acid
  misc_feature (18)..(25): n stands for any nucleotide and can be optionally absent
cugagugacugaugaggnnnnnnnnccgaaacccagac

SEQ ID NO: 6894 - RNA, 38 nt, Artificial Sequence
  Description of Artificial Sequence:  Enzymatic Nucleic Acid
  misc_feature (18)..(25): n stands for any nucleotide and can be optionally absent
aucugagucugaugaggnnnnnnnnccgaaauacccag

SEQ ID NO: 6895 - RNA, 38 nt, Artificial Sequence
  Description of Artificial Sequence:  Enzymatic Nucleic Acid
  misc_feature (18)..(25): n stands for any nucleotide and can be optionally absent
ugucaucucugaugaggnnnnnnnnccgaaagugauac

SEQ ID NO: 6896 - RNA, 38 nt, Artificial Sequence
  Description of Artificial Sequence:  Enzymatic Nucleic Acid
  misc_feature (18)..(25): n stands for any nucleotide and can be optionally absent
cgcuggagcugaugaggnnnnnnnnccgaaacacggug

SEQ ID NO: 6897 - RNA, 38 nt, Artificial Sequence
  Description of Artificial Sequence:  Enzymatic Nucleic Acid
  misc_feature (18)..(25): n stands for any nucleotide and can be optionally absent
cgucgcugcugaugaggnnnnnnnnccgaaaguacacg

SEQ ID NO: 6898 - RNA, 38 nt, Artificial Sequence
  Description of Artificial Sequence:  Enzymatic Nucleic Acid
  misc_feature (18)..(25): n stands for any nucleotide and can be optionally absent
aucuuuaacugaugaggnnnnnnnnccgaaaguccugc

SEQ ID NO: 6899 - RNA, 38 nt, Artificial Sequence
  Description of Artificial Sequence:  Enzymatic Nucleic Acid
  misc_feature (18)..(25): n stands for any nucleotide and can be optionally absent
caucuuuacugaugaggnnnnnnnnccgaaaaguccug

SEQ ID NO: 6900 - RNA, 38 nt, Artificial Sequence
  Description of Artificial Sequence:  Enzymatic Nucleic Acid
  misc_feature (18)..(25): n stands for any nucleotide and can be optionally absent
ccaucuuucugaugaggnnnnnnnnccgaaaaaguccu

SEQ ID NO: 6901 - RNA, 38 nt, Artificial Sequence
  Description of Artificial Sequence:  Enzymatic Nucleic Acid
  misc_feature (18)..(25): n stands for any nucleotide and can be optionally absent
accaucuucugaugaggnnnnnnnnccgaaaaaagucc

SEQ ID NO: 6902 - RNA, 38 nt, Artificial Sequence
  Description of Artificial Sequence:  Enzymatic Nucleic Acid
  misc_feature (18)..(25): n stands for any nucleotide and can be optionally absent
ucagcgugcugaugaggnnnnnnnnccgaaacugcagc

SEQ ID NO: 6903 - RNA, 38 nt, Artificial Sequence
  Description of Artificial Sequence:  Enzymatic Nucleic Acid
  misc_feature (18)..(25): n stands for any nucleotide and can be optionally absent
gucagcgucugaugaggnnnnnnnnccgaaaacugcag

SEQ ID NO: 6904 - RNA, 38 nt, Artificial Sequence
  Description of Artificial Sequence:  Enzymatic Nucleic Acid
  misc_feature (18)..(25): n stands for any nucleotide and can be optionally absent
uggucccucugaugaggnnnnnnnnccgaaagucagcg

SEQ ID NO: 6905 - RNA, 38 nt, Artificial Sequence
  Description of Artificial Sequence:  Enzymatic Nucleic Acid
  misc_feature (18)..(25): n stands for any nucleotide and can be optionally absent
caggaggucugaugaggnnnnnnnnccgaaagcugcag

SEQ ID NO: 6906 - RNA, 38 nt, Artificial Sequence
  Description of Artificial Sequence:  Enzymatic Nucleic Acid
  misc_feature (18)..(25): n stands for any nucleotide and can be optionally absent
uuaaacagcugaugaggnnnnnnnnccgaaaggugagc

SEQ ID NO: 6907 - RNA, 38 nt, Artificial Sequence
  Description of Artificial Sequence:  Enzymatic Nucleic Acid
  misc_feature (18)..(25): n stands for any nucleotide and can be optionally absent
uccauuuacugaugaggnnnnnnnnccgaaacaggagg

SEQ ID NO: 6908 - RNA, 38 nt, Artificial Sequence
  Description of Artificial Sequence:  Enzymatic Nucleic Acid
  misc_feature (18)..(25): n stands for any nucleotide and can be optionally absent
uuccauuucugaugaggnnnnnnnnccgaaaacaggag

SEQ ID NO: 6909 - RNA, 38 nt, Artificial Sequence
  Description of Artificial Sequence:  Enzymatic Nucleic Acid
  misc_feature (18)..(25): n stands for any nucleotide and can be optionally absent
cuuccauucugaugaggnnnnnnnnccgaaaaacagga

SEQ ID NO: 6910 - RNA, 38 nt, Artificial Sequence
  Description of Artificial Sequence:  Enzymatic Nucleic Acid
  misc_feature (18)..(25): n stands for any nucleotide and can be optionally absent
cgggacagcugaugaggnnnnnnnnccgaaaccacuuc

SEQ ID NO: 6911 - RNA, 38 nt, Artificial Sequence
  Description of Artificial Sequence:  Enzymatic Nucleic Acid
  misc_feature (18)..(25): n stands for any nucleotide and can be optionally absent
ggagccggcugaugaggnnnnnnnnccgaaacaggacc

SEQ ID NO: 6912 - RNA, 38 nt, Artificial Sequence
  Description of Artificial Sequence:  Enzymatic Nucleic Acid
  misc_feature (18)..(25): n stands for any nucleotide and can be optionally absent
ugggggcgcugaugaggnnnnnnnnccgaaagccggga

SEQ ID NO: 6913 - RNA, 38 nt, Artificial Sequence
  Description of Artificial Sequence:  Enzymatic Nucleic Acid
  misc_feature (18)..(25): n stands for any nucleotide and can be optionally absent
auuuccagcugaugaggnnnnnnnnccgaaaguugggg

SEQ ID NO: 6914 - RNA, 38 nt, Artificial Sequence
  Description of Artificial Sequence:  Enzymatic Nucleic Acid
  misc_feature (18)..(25): n stands for any nucleotide and can be optionally absent
ucucucgucugaugaggnnnnnnnnccgaaauuuccag

SEQ ID NO: 6915 - RNA, 38 nt, Artificial Sequence
  Description of Artificial Sequence:  Enzymatic Nucleic Acid
  misc_feature (18)..(25): n stands for any nucleotide and can be optionally absent
gaaaaucucugaugaggnnnnnnnnccgaaagcagcac

SEQ ID NO: 6916 - RNA, 38 nt, Artificial Sequence
  Description of Artificial Sequence:  Enzymatic Nucleic Acid
  misc_feature (18)..(25): n stands for any nucleotide and can be optionally absent
ugaaaauccugaugaggnnnnnnnnccgaaaagcagca

SEQ ID NO: 6917 - RNA, 38 nt, Artificial Sequence
  Description of Artificial Sequence:  Enzymatic Nucleic Acid
  misc_feature (18)..(25): n stands for any nucleotide and can be optionally absent
cacuugaacugaugaggnnnnnnnnccgaaaucuaagc

SEQ ID NO: 6918 - RNA, 38 nt, Artificial Sequence
  Description of Artificial Sequence:  Enzymatic Nucleic Acid
  misc_feature (18)..(25): n stands for any nucleotide and can be optionally absent
acacuugacugaugaggnnnnnnnnccgaaaaucuaag

SEQ ID NO: 6919 - RNA, 38 nt, Artificial Sequence
  Description of Artificial Sequence:  Enzymatic Nucleic Acid
  misc_feature (18)..(25): n stands for any nucleotide and can be optionally absent
aacacuugcugaugaggnnnnnnnnccgaaaaaucuaa

SEQ ID NO: 6920 - RNA, 38 nt, Artificial Sequence
  Description of Artificial Sequence:  Enzymatic Nucleic Acid
  misc_feature (18)..(25): n stands for any nucleotide and can be optionally absent
caacacuucugaugaggnnnnnnnnccgaaaaaaucua

SEQ ID NO: 6921 - RNA, 38 nt, Artificial Sequence
  Description of Artificial Sequence:  Enzymatic Nucleic Acid
  misc_feature (18)..(25): n stands for any nucleotide and can be optionally absent
gaaagaaccugaugaggnnnnnnnnccgaaacacuuga

SEQ ID NO: 6922 - RNA, 38 nt, Artificial Sequence
  Description of Artificial Sequence:  Enzymatic Nucleic Acid
  misc_feature (18)..(25): n stands for any nucleotide and can be optionally absent
gugguggacugaugaggnnnnnnnnccgaaagaacaac

SEQ ID NO: 6923 - RNA, 38 nt, Artificial Sequence
  Description of Artificial Sequence:  Enzymatic Nucleic Acid
  misc_feature (18)..(25): n stands for any nucleotide and can be optionally absent
ggugguggcugaugaggnnnnnnnnccgaaaagaacaa

SEQ ID NO: 6924 - RNA, 38 nt, Artificial Sequence
  Description of Artificial Sequence:  Enzymatic Nucleic Acid
  misc_feature (18)..(25): n stands for any nucleotide and can be optionally absent
ggguggugcugaugaggnnnnnnnnccgaaaaagaaca

SEQ ID NO: 6925 - RNA, 38 nt, Artificial Sequence
  Description of Artificial Sequence:  Enzymatic Nucleic Acid
  misc_feature (18)..(25): n stands for any nucleotide and can be optionally absent
aauguggccugaugaggnnnnnnnnccgaaacuuccgg

SEQ ID NO: 6926 - RNA, 38 nt, Artificial Sequence
  Description of Artificial Sequence:  Enzymatic Nucleic Acid
  misc_feature (18)..(25): n stands for any nucleotide and can be optionally absent
gaaaaucacugaugaggnnnnnnnnccgaaauguggcu

SEQ ID NO: 6927 - RNA, 38 nt, Artificial Sequence
  Description of Artificial Sequence:  Enzymatic Nucleic Acid
  misc_feature (18)..(25): n stands for any nucleotide and can be optionally absent
ugaaaauccugaugaggnnnnnnnnccgaaaauguggc

SEQ ID NO: 6928 - RNA, 38 nt, Artificial Sequence
  Description of Artificial Sequence:  Enzymatic Nucleic Acid
  misc_feature (18)..(25): n stands for any nucleotide and can be optionally absent
aaaaugaacugaugaggnnnnnnnnccgaaaucaaaug

SEQ ID NO: 6929 - RNA, 38 nt, Artificial Sequence
  Description of Artificial Sequence:  Enzymatic Nucleic Acid
  misc_feature (18)..(25): n stands for any nucleotide and can be optionally absent
aaaaaugacugaugaggnnnnnnnnccgaaaaucaaau

SEQ ID NO: 6930 - RNA, 38 nt, Artificial Sequence
  Description of Artificial Sequence:  Enzymatic Nucleic Acid
  misc_feature (18)..(25): n stands for any nucleotide and can be optionally absent
caaaaaugcugaugaggnnnnnnnnccgaaaaaucaaa

SEQ ID NO: 6931 - RNA, 38 nt, Artificial Sequence
  Description of Artificial Sequence:  Enzymatic Nucleic Acid
  misc_feature (18)..(25): n stands for any nucleotide and can be optionally absent
ccaaaaaucugaugaggnnnnnnnnccgaaaaaaucaa

SEQ ID NO: 6932 - RNA, 38 nt, Artificial Sequence
  Description of Artificial Sequence:  Enzymatic Nucleic Acid
  misc_feature (18)..(25): n stands for any nucleotide and can be optionally absent
ccuccaaacugaugaggnnnnnnnnccgaaaugaaaau

SEQ ID NO: 6933 - RNA, 38 nt, Artificial Sequence
  Description of Artificial Sequence:  Enzymatic Nucleic Acid
  misc_feature (18)..(25): n stands for any nucleotide and can be optionally absent
uccuccaacugaugaggnnnnnnnnccgaaaaugaaaa

SEQ ID NO: 6934 - RNA, 38 nt, Artificial Sequence
  Description of Artificial Sequence:  Enzymatic Nucleic Acid
  misc_feature (18)..(25): n stands for any nucleotide and can be optionally absent
cuccuccacugaugaggnnnnnnnnccgaaaaaugaaa

SEQ ID NO: 6935 - RNA, 38 nt, Artificial Sequence
  Description of Artificial Sequence:  Enzymatic Nucleic Acid
  misc_feature (18)..(25): n stands for any nucleotide and can be optionally absent
ccuccucccugaugaggnnnnnnnnccgaaaaaaugaa

SEQ ID NO: 6936 - RNA, 38 nt, Artificial Sequence
  Description of Artificial Sequence:  Enzymatic Nucleic Acid
  misc_feature (18)..(25): n stands for any nucleotide and can be optionally absent
ugcagucucugaugaggnnnnnnnnccgaaaggucccu

SEQ ID NO: 6937 - RNA, 38 nt, Artificial Sequence
  Description of Artificial Sequence:  Enzymatic Nucleic Acid
  misc_feature (18)..(25): n stands for any nucleotide and can be optionally absent
cugaggaccugaugaggnnnnnnnnccgaaagcuccuu

SEQ ID NO: 6938 - RNA, 38 nt, Artificial Sequence
  Description of Artificial Sequence:  Enzymatic Nucleic Acid
  misc_feature (18)..(25): n stands for any nucleotide and can be optionally absent
gcccugagcugaugaggnnnnnnnnccgaaacaagcuc

SEQ ID NO: 6939 - RNA, 38 nt, Artificial Sequence
  Description of Artificial Sequence:  Enzymatic Nucleic Acid
  misc_feature (18)..(25): n stands for any nucleotide and can be optionally absent
aaugcccucugaugaggnnnnnnnnccgaaaggacaag

SEQ ID NO: 6940 - RNA, 38 nt, Artificial Sequence
  Description of Artificial Sequence:  Enzymatic Nucleic Acid
  misc_feature (18)..(25): n stands for any nucleotide and can be optionally absent
ucucuggacugaugaggnnnnnnnnccgaaaugcccug

SEQ ID NO: 6941 - RNA, 38 nt, Artificial Sequence
  Description of Artificial Sequence:  Enzymatic Nucleic Acid
  misc_feature (18)..(25): n stands for any nucleotide and can be optionally absent
uucucuggcugaugaggnnnnnnnnccgaaaaugcccu

SEQ ID NO: 6942 - RNA, 38 nt, Artificial Sequence
  Description of Artificial Sequence:  Enzymatic Nucleic Acid
  misc_feature (18)..(25): n stands for any nucleotide and can be optionally absent
cuucucugcugaugaggnnnnnnnnccgaaaaaugccc

SEQ ID NO: 6943 - RNA, 38 nt, Artificial Sequence
  Description of Artificial Sequence:  Enzymatic Nucleic Acid
  misc_feature (18)..(25): n stands for any nucleotide and can be optionally absent
guagaguccugaugaggnnnnnnnnccgaaacacauuc

SEQ ID NO: 6944 - RNA, 38 nt, Artificial Sequence
  Description of Artificial Sequence:  Enzymatic Nucleic Acid
  misc_feature (18)..(25): n stands for any nucleotide and can be optionally absent
agagaguacugaugaggnnnnnnnnccgaaagucaaca

SEQ ID NO: 6945 - RNA, 38 nt, Artificial Sequence
  Description of Artificial Sequence:  Enzymatic Nucleic Acid
  misc_feature (18)..(25): n stands for any nucleotide and can be optionally absent
aaagagagcugaugaggnnnnnnnnccgaaagagucaa

SEQ ID NO: 6946 - RNA, 38 nt, Artificial Sequence
  Description of Artificial Sequence:  Enzymatic Nucleic Acid
  misc_feature (18)..(25): n stands for any nucleotide and can be optionally absent
ggaaaagacugaugaggnnnnnnnnccgaaaguagagu

SEQ ID NO: 6947 - RNA, 38 nt, Artificial Sequence
  Description of Artificial Sequence:  Enzymatic Nucleic Acid
  misc_feature (18)..(25): n stands for any nucleotide and can be optionally absent
auggaaaacugaugaggnnnnnnnnccgaaagaguaga

SEQ ID NO: 6948 - RNA, 38 nt, Artificial Sequence
  Description of Artificial Sequence:  Enzymatic Nucleic Acid
  misc_feature (18)..(25): n stands for any nucleotide and can be optionally absent
gaauggaacugaugaggnnnnnnnnccgaaagagagua

SEQ ID NO: 6949 - RNA, 38 nt, Artificial Sequence
  Description of Artificial Sequence:  Enzymatic Nucleic Acid
  misc_feature (18)..(25): n stands for any nucleotide and can be optionally absent
ugaauggacugaugaggnnnnnnnnccgaaaagagagu

SEQ ID NO: 6950 - RNA, 38 nt, Artificial Sequence
  Description of Artificial Sequence:  Enzymatic Nucleic Acid
  misc_feature (18)..(25): n stands for any nucleotide and can be optionally absent
augaauggcugaugaggnnnnnnnnccgaaaaagagag

SEQ ID NO: 6951 - RNA, 38 nt, Artificial Sequence
  Description of Artificial Sequence:  Enzymatic Nucleic Acid
  misc_feature (18)..(25): n stands for any nucleotide and can be optionally absent
aaugaaugcugaugaggnnnnnnnnccgaaaaaagaga

SEQ ID NO: 6952 - RNA, 38 nt, Artificial Sequence
  Description of Artificial Sequence:  Enzymatic Nucleic Acid
  misc_feature (18)..(25): n stands for any nucleotide and can be optionally absent
uuuaaaugcugaugaggnnnnnnnnccgaaauggaaaa

SEQ ID NO: 6953 - RNA, 38 nt, Artificial Sequence
  Description of Artificial Sequence:  Enzymatic Nucleic Acid
  misc_feature (18)..(25): n stands for any nucleotide and can be optionally absent
uuuuaaaucugaugaggnnnnnnnnccgaaaauggaaa

SEQ ID NO: 6954 - RNA, 38 nt, Artificial Sequence
  Description of Artificial Sequence:  Enzymatic Nucleic Acid
  misc_feature (18)..(25): n stands for any nucleotide and can be optionally absent
gacuuuuacugaugaggnnnnnnnnccgaaaugaaugg

SEQ ID NO: 6955 - RNA, 38 nt, Artificial Sequence
  Description of Artificial Sequence:  Enzymatic Nucleic Acid
  misc_feature (18)..(25): n stands for any nucleotide and can be optionally absent
ggacuuuucugaugaggnnnnnnnnccgaaaaugaaug

SEQ ID NO: 6956 - RNA, 38 nt, Artificial Sequence
  Description of Artificial Sequence:  Enzymatic Nucleic Acid
  misc_feature (18)..(25): n stands for any nucleotide and can be optionally absent
aggacuuucugaugaggnnnnnnnnccgaaaaaugaau

SEQ ID NO: 6957 - RNA, 38 nt, Artificial Sequence
  Description of Artificial Sequence:  Enzymatic Nucleic Acid
  misc_feature (18)..(25): n stands for any nucleotide and can be optionally absent
uuauauagcugaugaggnnnnnnnnccgaaacuuuuaa

SEQ ID NO: 6958 - RNA, 38 nt, Artificial Sequence
  Description of Artificial Sequence:  Enzymatic Nucleic Acid
  misc_feature (18)..(25): n stands for any nucleotide and can be optionally absent
acauuauacugaugaggnnnnnnnnccgaaaggacuuu

SEQ ID NO: 6959 - RNA, 38 nt, Artificial Sequence
  Description of Artificial Sequence:  Enzymatic Nucleic Acid
  misc_feature (18)..(25): n stands for any nucleotide and can be optionally absent
gcacauuacugaugaggnnnnnnnnccgaaauaggacu

SEQ ID NO: 6960 - RNA, 38 nt, Artificial Sequence
  Description of Artificial Sequence:  Enzymatic Nucleic Acid
  misc_feature (18)..(25): n stands for any nucleotide and can be optionally absent
gggcacaucugaugaggnnnnnnnnccgaaauauagga

SEQ ID NO: 6961 - RNA, 38 nt, Artificial Sequence
  Description of Artificial Sequence:  Enzymatic Nucleic Acid
  misc_feature (18)..(25): n stands for any nucleotide and can be optionally absent
gguagugacugaugaggnnnnnnnnccgaaaccacagc

SEQ ID NO: 6962 - RNA, 38 nt, Artificial Sequence
  Description of Artificial Sequence:  Enzymatic Nucleic Acid
  misc_feature (18)..(25): n stands for any nucleotide and can be optionally absent
cugguagucugaugaggnnnnnnnnccgaaagaccaca

SEQ ID NO: 6963 - RNA, 38 nt, Artificial Sequence
  Description of Artificial Sequence:  Enzymatic Nucleic Acid
  misc_feature (18)..(25): n stands for any nucleotide and can be optionally absent
uuaacuggcugaugaggnnnnnnnnccgaaagugagac

SEQ ID NO: 6964 - RNA, 38 nt, Artificial Sequence
  Description of Artificial Sequence:  Enzymatic Nucleic Acid
  misc_feature (18)..(25): n stands for any nucleotide and can be optionally absent
uuugcuuucugaugaggnnnnnnnnccgaaacugguag

SEQ ID NO: 6965 - RNA, 38 nt, Artificial Sequence
  Description of Artificial Sequence:  Enzymatic Nucleic Acid
  misc_feature (18)..(25): n stands for any nucleotide and can be optionally absent
uuuugcuucugaugaggnnnnnnnnccgaaaacuggua

SEQ ID NO: 6966 - RNA, 38 nt, Artificial Sequence
  Description of Artificial Sequence:  Enzymatic Nucleic Acid
  misc_feature (18)..(25): n stands for any nucleotide and can be optionally absent
guguuugacugaugaggnnnnnnnnccgaaagucuuuu

SEQ ID NO: 6967 - RNA, 38 nt, Artificial Sequence
  Description of Artificial Sequence:  Enzymatic Nucleic Acid
  misc_feature (18)..(25): n stands for any nucleotide and can be optionally absent
cguguuugcugaugaggnnnnnnnnccgaaaagucuuu

SEQ ID NO: 6968 - RNA, 38 nt, Artificial Sequence
  Description of Artificial Sequence:  Enzymatic Nucleic Acid
  misc_feature (18)..(25): n stands for any nucleotide and can be optionally absent
acguguuucugaugaggnnnnnnnnccgaaaaagucuu

SEQ ID NO: 6969 - RNA, 38 nt, Artificial Sequence
  Description of Artificial Sequence:  Enzymatic Nucleic Acid
  misc_feature (18)..(25): n stands for any nucleotide and can be optionally absent
ggaggacacugaugaggnnnnnnnnccgaaaguccacg

SEQ ID NO: 6970 - RNA, 38 nt, Artificial Sequence
  Description of Artificial Sequence:  Enzymatic Nucleic Acid
  misc_feature (18)..(25): n stands for any nucleotide and can be optionally absent
ucuuggagcugaugaggnnnnnnnnccgaaacagaguc

SEQ ID NO: 6971 - RNA, 38 nt, Artificial Sequence
  Description of Artificial Sequence:  Enzymatic Nucleic Acid
  misc_feature (18)..(25): n stands for any nucleotide and can be optionally absent
acuucuugcugaugaggnnnnnnnnccgaaaggacaga

SEQ ID NO: 6972 - RNA, 38 nt, Artificial Sequence
  Description of Artificial Sequence:  Enzymatic Nucleic Acid
  misc_feature (18)..(25): n stands for any nucleotide and can be optionally absent
guuucacacugaugaggnnnnnnnnccgaaaggugccg

SEQ ID NO: 6973 - RNA, 38 nt, Artificial Sequence
  Description of Artificial Sequence:  Enzymatic Nucleic Acid
  misc_feature (18)..(25): n stands for any nucleotide and can be optionally absent
gcccauuccugaugaggnnnnnnnnccgaaauccaguu

SEQ ID NO: 6974 - RNA, 38 nt, Artificial Sequence
  Description of Artificial Sequence:  Enzymatic Nucleic Acid
  misc_feature (18)..(25): n stands for any nucleotide and can be optionally absent
aacacacacugaugaggnnnnnnnnccgaaagcauugc

SEQ ID NO: 6975 - RNA, 38 nt, Artificial Sequence
  Description of Artificial Sequence:  Enzymatic Nucleic Acid
  misc_feature (18)..(25): n stands for any nucleotide and can be optionally absent
caacacaccugaugaggnnnnnnnnccgaaaagcauug

SEQ ID NO: 6976 - RNA, 38 nt, Artificial Sequence
  Description of Artificial Sequence:  Enzymatic Nucleic Acid
  misc_feature (18)..(25): n stands for any nucleotide and can be optionally absent
ccauccuccugaugaggnnnnnnnnccgaaacacacaa

SEQ ID NO: 6977 - RNA, 38 nt, Artificial Sequence
  Description of Artificial Sequence:  Enzymatic Nucleic Acid
  misc_feature (18)..(25): n stands for any nucleotide and can be optionally absent
ggcccuggcugaugaggnnnnnnnnccgaaacaucuca

SEQ ID NO: 6978 - RNA, 38 nt, Artificial Sequence
  Description of Artificial Sequence:  Enzymatic Nucleic Acid
  misc_feature (18)..(25): n stands for any nucleotide and can be optionally absent
gguagacacugaugaggnnnnnnnnccgaaacucggcc

SEQ ID NO: 6979 - RNA, 38 nt, Artificial Sequence
  Description of Artificial Sequence:  Enzymatic Nucleic Acid
  misc_feature (18)..(25): n stands for any nucleotide and can be optionally absent
ccaagguacugaugaggnnnnnnnnccgaaacagacuc

SEQ ID NO: 6980 - RNA, 38 nt, Artificial Sequence
  Description of Artificial Sequence:  Enzymatic Nucleic Acid
  misc_feature (18)..(25): n stands for any nucleotide and can be optionally absent
cuccaaggcugaugaggnnnnnnnnccgaaagacagac

SEQ ID NO: 6981 - RNA, 38 nt, Artificial Sequence
  Description of Artificial Sequence:  Enzymatic Nucleic Acid
  misc_feature (18)..(25): n stands for any nucleotide and can be optionally absent
aagccucccugaugaggnnnnnnnnccgaaagguagac

SEQ ID NO: 6982 - RNA, 38 nt, Artificial Sequence
  Description of Artificial Sequence:  Enzymatic Nucleic Acid
  misc_feature (18)..(25): n stands for any nucleotide and can be optionally absent
ccuccacacugaugaggnnnnnnnnccgaaagccucca

SEQ ID NO: 6983 - RNA, 38 nt, Artificial Sequence
  Description of Artificial Sequence:  Enzymatic Nucleic Acid
  misc_feature (18)..(25): n stands for any nucleotide and can be optionally absent
uccuccaccugaugaggnnnnnnnnccgaaaagccucc

SEQ ID NO: 6984 - RNA, 38 nt, Artificial Sequence
  Description of Artificial Sequence:  Enzymatic Nucleic Acid
  misc_feature (18)..(25): n stands for any nucleotide and can be optionally absent
uuggcucacugaugaggnnnnnnnnccgaaagcccgca

SEQ ID NO: 6985 - RNA, 38 nt, Artificial Sequence
  Description of Artificial Sequence:  Enzymatic Nucleic Acid
  misc_feature (18)..(25): n stands for any nucleotide and can be optionally absent
ccacacuucugaugaggnnnnnnnnccgaaacacuugg

SEQ ID NO: 6986 - RNA, 38 nt, Artificial Sequence
  Description of Artificial Sequence:  Enzymatic Nucleic Acid
  misc_feature (18)..(25): n stands for any nucleotide and can be optionally absent
cccacacucugaugaggnnnnnnnnccgaaaacacuug

SEQ ID NO: 6987 - RNA, 38 nt, Artificial Sequence
  Description of Artificial Sequence:  Enzymatic Nucleic Acid
  misc_feature (18)..(25): n stands for any nucleotide and can be optionally absent
cuccgagccugaugaggnnnnnnnnccgaaacuugcgc

SEQ ID NO: 6988 - RNA, 38 nt, Artificial Sequence
  Description of Artificial Sequence:  Enzymatic Nucleic Acid
  misc_feature (18)..(25): n stands for any nucleotide and can be optionally absent
cgcucucccugaugaggnnnnnnnnccgaaagcgacuu

SEQ ID NO: 6989 - RNA, 38 nt, Artificial Sequence
  Description of Artificial Sequence:  Enzymatic Nucleic Acid
  misc_feature (18)..(25): n stands for any nucleotide and can be optionally absent
caggcucccugaugaggnnnnnnnnccgaaaccgcucu

SEQ ID NO: 6990 - RNA, 38 nt, Artificial Sequence
  Description of Artificial Sequence:  Enzymatic Nucleic Acid
  misc_feature (18)..(25): n stands for any nucleotide and can be optionally absent
gccagcaccugaugaggnnnnnnnnccgaaaugcaucu

SEQ ID NO: 6991 - RNA, 38 nt, Artificial Sequence
  Description of Artificial Sequence:  Enzymatic Nucleic Acid
  misc_feature (18)..(25): n stands for any nucleotide and can be optionally absent
cuccaccacugaugaggnnnnnnnnccgaaagccagca

SEQ ID NO: 6992 - RNA, 38 nt, Artificial Sequence
  Description of Artificial Sequence:  Enzymatic Nucleic Acid
  misc_feature (18)..(25): n stands for any nucleotide and can be optionally absent
caggccaccugaugaggnnnnnnnnccgaaagcccacc

SEQ ID NO: 6993 - RNA, 38 nt, Artificial Sequence
  Description of Artificial Sequence:  Enzymatic Nucleic Acid
  misc_feature (18)..(25): n stands for any nucleotide and can be optionally absent
cguuuccucugaugaggnnnnnnnnccgaaacaggcca

SEQ ID NO: 6994 - RNA, 38 nt, Artificial Sequence
  Description of Artificial Sequence:  Enzymatic Nucleic Acid
  misc_feature (18)..(25): n stands for any nucleotide and can be optionally absent
caaaaccacugaugaggnnnnnnnnccgaaacccugcc

SEQ ID NO: 6995 - RNA, 38 nt, Artificial Sequence
  Description of Artificial Sequence:  Enzymatic Nucleic Acid
  misc_feature (18)..(25): n stands for any nucleotide and can be optionally absent
ccaaaacccugaugaggnnnnnnnnccgaaaacccugc

SEQ ID NO: 6996 - RNA, 38 nt, Artificial Sequence
  Description of Artificial Sequence:  Enzymatic Nucleic Acid
  misc_feature (18)..(25): n stands for any nucleotide and can be optionally absent
ccuuccaacugaugaggnnnnnnnnccgaaaccaaacc

SEQ ID NO: 6997 - RNA, 38 nt, Artificial Sequence
  Description of Artificial Sequence:  Enzymatic Nucleic Acid
  misc_feature (18)..(25): n stands for any nucleotide and can be optionally absent
accuuccacugaugaggnnnnnnnnccgaaaaccaaac

SEQ ID NO: 6998 - RNA, 38 nt, Artificial Sequence
  Description of Artificial Sequence:  Enzymatic Nucleic Acid
  misc_feature (18)..(25): n stands for any nucleotide and can be optionally absent
aaccuucccugaugaggnnnnnnnnccgaaaaaccaaa

SEQ ID NO: 6999 - RNA, 38 nt, Artificial Sequence
  Description of Artificial Sequence:  Enzymatic Nucleic Acid
  misc_feature (18)..(25): n stands for any nucleotide and can be optionally absent
agcacgcacugaugaggnnnnnnnnccgaaaccuucca

SEQ ID NO: 7000 - RNA, 38 nt, Artificial Sequence
  Description of Artificial Sequence:  Enzymatic Nucleic Acid
  misc_feature (18)..(25): n stands for any nucleotide and can be optionally absent
gagcacgccugaugaggnnnnnnnnccgaaaaccuucc

SEQ ID NO: 7001 - RNA, 38 nt, Artificial Sequence
  Description of Artificial Sequence:  Enzymatic Nucleic Acid
  misc_feature (18)..(25): n stands for any nucleotide and can be optionally absent
acugugaacugaugaggnnnnnnnnccgaaagcacgca

SEQ ID NO: 7002 - RNA, 38 nt, Artificial Sequence
  Description of Artificial Sequence:  Enzymatic Nucleic Acid
  misc_feature (18)..(25): n stands for any nucleotide and can be optionally absent
cgacugugcugaugaggnnnnnnnnccgaaagagcacg

SEQ ID NO: 7003 - RNA, 38 nt, Artificial Sequence
  Description of Artificial Sequence:  Enzymatic Nucleic Acid
  misc_feature (18)..(25): n stands for any nucleotide and can be optionally absent
ccgacugucugaugaggnnnnnnnnccgaaaagagcac

SEQ ID NO: 7004 - RNA, 38 nt, Artificial Sequence
  Description of Artificial Sequence:  Enzymatic Nucleic Acid
  misc_feature (18)..(25): n stands for any nucleotide and can be optionally absent
uguaaccccugaugaggnnnnnnnnccgaaacugugaa

SEQ ID NO: 7005 - RNA, 38 nt, Artificial Sequence
  Description of Artificial Sequence:  Enzymatic Nucleic Acid
  misc_feature (18)..(25): n stands for any nucleotide and can be optionally absent
ucgccugucugaugaggnnnnnnnnccgaaacccgacu

SEQ ID NO: 7006 - RNA, 38 nt, Artificial Sequence
  Description of Artificial Sequence:  Enzymatic Nucleic Acid
  misc_feature (18)..(25): n stands for any nucleotide and can be optionally absent
cucgccugcugaugaggnnnnnnnnccgaaaacccgac

SEQ ID NO: 7007 - RNA, 38 nt, Artificial Sequence
  Description of Artificial Sequence:  Enzymatic Nucleic Acid
  misc_feature (18)..(25): n stands for any nucleotide and can be optionally absent
ccacagggcugaugaggnnnnnnnnccgaaacucgccu

SEQ ID NO: 7008 - RNA, 38 nt, Artificial Sequence
  Description of Artificial Sequence:  Enzymatic Nucleic Acid
  misc_feature (18)..(25): n stands for any nucleotide and can be optionally absent
gccacaggcugaugaggnnnnnnnnccgaaaacucgcc

SEQ ID NO: 7009 - RNA, 38 nt, Artificial Sequence
  Description of Artificial Sequence:  Enzymatic Nucleic Acid
  misc_feature (18)..(25): n stands for any nucleotide and can be optionally absent
gaguaggacugaugaggnnnnnnnnccgaaacgccaca

SEQ ID NO: 7010 - RNA, 38 nt, Artificial Sequence
  Description of Artificial Sequence:  Enzymatic Nucleic Acid
  misc_feature (18)..(25): n stands for any nucleotide and can be optionally absent
ggaguaggcugaugaggnnnnnnnnccgaaaacgccac

SEQ ID NO: 7011 - RNA, 38 nt, Artificial Sequence
  Description of Artificial Sequence:  Enzymatic Nucleic Acid
  misc_feature (18)..(25): n stands for any nucleotide and can be optionally absent
aggaguagcugaugaggnnnnnnnnccgaaaaacgcca

SEQ ID NO: 7012 - RNA, 38 nt, Artificial Sequence
  Description of Artificial Sequence:  Enzymatic Nucleic Acid
  misc_feature (18)..(25): n stands for any nucleotide and can be optionally absent
auuaggagcugaugaggnnnnnnnnccgaaaggaaacg

SEQ ID NO: 7013 - RNA, 38 nt, Artificial Sequence
  Description of Artificial Sequence:  Enzymatic Nucleic Acid
  misc_feature (18)..(25): n stands for any nucleotide and can be optionally absent
cucauuagcugaugaggnnnnnnnnccgaaaguaggaa

SEQ ID NO: 7014 - RNA, 38 nt, Artificial Sequence
  Description of Artificial Sequence:  Enzymatic Nucleic Acid
  misc_feature (18)..(25): n stands for any nucleotide and can be optionally absent
acucucaucugaugaggnnnnnnnnccgaaaggaguag

SEQ ID NO: 7015 - RNA, 38 nt, Artificial Sequence
  Description of Artificial Sequence:  Enzymatic Nucleic Acid
  misc_feature (18)..(25): n stands for any nucleotide and can be optionally absent
ccggaaggcugaugaggnnnnnnnnccgaaacucucau

SEQ ID NO: 7016 - RNA, 38 nt, Artificial Sequence
  Description of Artificial Sequence:  Enzymatic Nucleic Acid
  misc_feature (18)..(25): n stands for any nucleotide and can be optionally absent
uccggaagcugaugaggnnnnnnnnccgaaaacucuca

SEQ ID NO: 7017 - RNA, 38 nt, Artificial Sequence
  Description of Artificial Sequence:  Enzymatic Nucleic Acid
  misc_feature (18)..(25): n stands for any nucleotide and can be optionally absent
gaguccggcugaugaggnnnnnnnnccgaaaggaacuc

SEQ ID NO: 7018 - RNA, 38 nt, Artificial Sequence
  Description of Artificial Sequence:  Enzymatic Nucleic Acid
  misc_feature (18)..(25): n stands for any nucleotide and can be optionally absent
agaguccgcugaugaggnnnnnnnnccgaaaaggaacu

SEQ ID NO: 7019 - RNA, 38 nt, Artificial Sequence
  Description of Artificial Sequence:  Enzymatic Nucleic Acid
  misc_feature (18)..(25): n stands for any nucleotide and can be optionally absent
acacguaacugaugaggnnnnnnnnccgaaaguccgga

SEQ ID NO: 7020 - RNA, 38 nt, Artificial Sequence
  Description of Artificial Sequence:  Enzymatic Nucleic Acid
  misc_feature (18)..(25): n stands for any nucleotide and can be optionally absent
agacacgucugaugaggnnnnnnnnccgaaagaguccg

SEQ ID NO: 7021 - RNA, 38 nt, Artificial Sequence
  Description of Artificial Sequence:  Enzymatic Nucleic Acid
  misc_feature (18)..(25): n stands for any nucleotide and can be optionally absent
gagacacgcugaugaggnnnnnnnnccgaaaagagucc

SEQ ID NO: 7022 - RNA, 38 nt, Artificial Sequence
  Description of Artificial Sequence:  Enzymatic Nucleic Acid
  misc_feature (18)..(25): n stands for any nucleotide and can be optionally absent
ggccaggacugaugaggnnnnnnnnccgaaacacguaa

SEQ ID NO: 7023 - RNA, 38 nt, Artificial Sequence
  Description of Artificial Sequence:  Enzymatic Nucleic Acid
  misc_feature (18)..(25): n stands for any nucleotide and can be optionally absent
caggccagcugaugaggnnnnnnnnccgaaagacacgu

SEQ ID NO: 7024 - RNA, 38 nt, Artificial Sequence
  Description of Artificial Sequence:  Enzymatic Nucleic Acid
  misc_feature (18)..(25): n stands for any nucleotide and can be optionally absent
gaaggagccugaugaggnnnnnnnnccgaaagcugcau

SEQ ID NO: 7025 - RNA, 38 nt, Artificial Sequence
  Description of Artificial Sequence:  Enzymatic Nucleic Acid
  misc_feature (18)..(25): n stands for any nucleotide and can be optionally absent
ugaggaagcugaugaggnnnnnnnnccgaaagcaagcu

SEQ ID NO: 7026 - RNA, 38 nt, Artificial Sequence
  Description of Artificial Sequence:  Enzymatic Nucleic Acid
  misc_feature (18)..(25): n stands for any nucleotide and can be optionally absent
agaugaggcugaugaggnnnnnnnnccgaaaggagcaa

SEQ ID NO: 7027 - RNA, 38 nt, Artificial Sequence
  Description of Artificial Sequence:  Enzymatic Nucleic Acid
  misc_feature (18)..(25): n stands for any nucleotide and can be optionally absent
gagaugagcugaugaggnnnnnnnnccgaaaaggagca

SEQ ID NO: 7028 - RNA, 38 nt, Artificial Sequence
  Description of Artificial Sequence:  Enzymatic Nucleic Acid
  misc_feature (18)..(25): n stands for any nucleotide and can be optionally absent
ugagagaucugaugaggnnnnnnnnccgaaaggaagga

SEQ ID NO: 7029 - RNA, 38 nt, Artificial Sequence
  Description of Artificial Sequence:  Enzymatic Nucleic Acid
  misc_feature (18)..(25): n stands for any nucleotide and can be optionally absent
gccugagacugaugaggnnnnnnnnccgaaaugaggaa

SEQ ID NO: 7030 - RNA, 38 nt, Artificial Sequence
  Description of Artificial Sequence:  Enzymatic Nucleic Acid
  misc_feature (18)..(25): n stands for any nucleotide and can be optionally absent
cagccugacugaugaggnnnnnnnnccgaaagaugagg

SEQ ID NO: 7031 - RNA, 38 nt, Artificial Sequence
  Description of Artificial Sequence:  Enzymatic Nucleic Acid
  misc_feature (18)..(25): n stands for any nucleotide and can be optionally absent
cacagccucugaugaggnnnnnnnnccgaaagagauga

SEQ ID NO: 7032 - RNA, 38 nt, Artificial Sequence
  Description of Artificial Sequence:  Enzymatic Nucleic Acid
  misc_feature (18)..(25): n stands for any nucleotide and can be optionally absent
ucugaauucugaugaggnnnnnnnnccgaaaggcacag

SEQ ID NO: 7033 - RNA, 38 nt, Artificial Sequence
  Description of Artificial Sequence:  Enzymatic Nucleic Acid
  misc_feature (18)..(25): n stands for any nucleotide and can be optionally absent
uucugaaucugaugaggnnnnnnnnccgaaaaggcaca

SEQ ID NO: 7034 - RNA, 38 nt, Artificial Sequence
  Description of Artificial Sequence:  Enzymatic Nucleic Acid
  misc_feature (18)..(25): n stands for any nucleotide and can be optionally absent
guguucugcugaugaggnnnnnnnnccgaaauuaaggc

SEQ ID NO: 7035 - RNA, 38 nt, Artificial Sequence
  Description of Artificial Sequence:  Enzymatic Nucleic Acid
  misc_feature (18)..(25): n stands for any nucleotide and can be optionally absent
gguguucucugaugaggnnnnnnnnccgaaaauuaagg

SEQ ID NO: 7036 - RNA, 38 nt, Artificial Sequence
  Description of Artificial Sequence:  Enzymatic Nucleic Acid
  misc_feature (18)..(25): n stands for any nucleotide and can be optionally absent
ccucugcccugaugaggnnnnnnnnccgaaacguuccu

SEQ ID NO: 7037 - RNA, 38 nt, Artificial Sequence
  Description of Artificial Sequence:  Enzymatic Nucleic Acid
  misc_feature (18)..(25): n stands for any nucleotide and can be optionally absent
cccgucagcugaugaggnnnnnnnnccgaaagccucug

SEQ ID NO: 7038 - RNA, 38 nt, Artificial Sequence
  Description of Artificial Sequence:  Enzymatic Nucleic Acid
  misc_feature (18)..(25): n stands for any nucleotide and can be optionally absent
guucucaccugaugaggnnnnnnnnccgaaauucuucg

SEQ ID NO: 7039 - RNA, 38 nt, Artificial Sequence
  Description of Artificial Sequence:  Enzymatic Nucleic Acid
  misc_feature (18)..(25): n stands for any nucleotide and can be optionally absent
gaaacccucugaugaggnnnnnnnnccgaaaguuucug

SEQ ID NO: 7040 - RNA, 38 nt, Artificial Sequence
  Description of Artificial Sequence:  Enzymatic Nucleic Acid
  misc_feature (18)..(25): n stands for any nucleotide and can be optionally absent
ccagcagacugaugaggnnnnnnnnccgaaacccugag

SEQ ID NO: 7041 - RNA, 38 nt, Artificial Sequence
  Description of Artificial Sequence:  Enzymatic Nucleic Acid
  misc_feature (18)..(25): n stands for any nucleotide and can be optionally absent
cccagcagcugaugaggnnnnnnnnccgaaaacccuga

SEQ ID NO: 7042 - RNA, 38 nt, Artificial Sequence
  Description of Artificial Sequence:  Enzymatic Nucleic Acid
  misc_feature (18)..(25): n stands for any nucleotide and can be optionally absent
acccagcacugaugaggnnnnnnnnccgaaaaacccug

SEQ ID NO: 7043 - RNA, 38 nt, Artificial Sequence
  Description of Artificial Sequence:  Enzymatic Nucleic Acid
  misc_feature (18)..(25): n stands for any nucleotide and can be optionally absent
aacccucacugaugaggnnnnnnnnccgaaaccugcca

SEQ ID NO: 7044 - RNA, 38 nt, Artificial Sequence
  Description of Artificial Sequence:  Enzymatic Nucleic Acid
  misc_feature (18)..(25): n stands for any nucleotide and can be optionally absent
ugacagagcugaugaggnnnnnnnnccgaaacccucag

SEQ ID NO: 7045 - RNA, 38 nt, Artificial Sequence
  Description of Artificial Sequence:  Enzymatic Nucleic Acid
  misc_feature (18)..(25): n stands for any nucleotide and can be optionally absent
uugacagacugaugaggnnnnnnnnccgaaaacccuca

SEQ ID NO: 7046 - RNA, 38 nt, Artificial Sequence
  Description of Artificial Sequence:  Enzymatic Nucleic Acid
  misc_feature (18)..(25): n stands for any nucleotide and can be optionally absent
acuugacacugaugaggnnnnnnnnccgaaagaacccu

SEQ ID NO: 7047 - RNA, 38 nt, Artificial Sequence
  Description of Artificial Sequence:  Enzymatic Nucleic Acid
  misc_feature (18)..(25): n stands for any nucleotide and can be optionally absent
cgccacuucugaugaggnnnnnnnnccgaaacagagaa

SEQ ID NO: 7048 - RNA, 38 nt, Artificial Sequence
  Description of Artificial Sequence:  Enzymatic Nucleic Acid
  misc_feature (18)..(25): n stands for any nucleotide and can be optionally absent
ugagccuucugaugaggnnnnnnnnccgaaaccgccac

SEQ ID NO: 7049 - RNA, 38 nt, Artificial Sequence
  Description of Artificial Sequence:  Enzymatic Nucleic Acid
  misc_feature (18)..(25): n stands for any nucleotide and can be optionally absent
accagccucugaugaggnnnnnnnnccgaaagccuuua

SEQ ID NO: 7050 - RNA, 38 nt, Artificial Sequence
  Description of Artificial Sequence:  Enzymatic Nucleic Acid
  misc_feature (18)..(25): n stands for any nucleotide and can be optionally absent
agaggaagcugaugaggnnnnnnnnccgaaacaccagc

SEQ ID NO: 7051 - RNA, 38 nt, Artificial Sequence
  Description of Artificial Sequence:  Enzymatic Nucleic Acid
  misc_feature (18)..(25): n stands for any nucleotide and can be optionally absent
uagaggaacugaugaggnnnnnnnnccgaaaacaccag

SEQ ID NO: 7052 - RNA, 38 nt, Artificial Sequence
  Description of Artificial Sequence:  Enzymatic Nucleic Acid
  misc_feature (18)..(25): n stands for any nucleotide and can be optionally absent
gauagaggcugaugaggnnnnnnnnccgaaagaacacc

SEQ ID NO: 7053 - RNA, 38 nt, Artificial Sequence
  Description of Artificial Sequence:  Enzymatic Nucleic Acid
  misc_feature (18)..(25): n stands for any nucleotide and can be optionally absent
agauagagcugaugaggnnnnnnnnccgaaaagaacac

SEQ ID NO: 7054 - RNA, 38 nt, Artificial Sequence
  Description of Artificial Sequence:  Enzymatic Nucleic Acid
  misc_feature (18)..(25): n stands for any nucleotide and can be optionally absent
uggagauacugaugaggnnnnnnnnccgaaaggaagaa

SEQ ID NO: 7055 - RNA, 38 nt, Artificial Sequence
  Description of Artificial Sequence:  Enzymatic Nucleic Acid
  misc_feature (18)..(25): n stands for any nucleotide and can be optionally absent
aguggagacugaugaggnnnnnnnnccgaaagaggaag

SEQ ID NO: 7056 - RNA, 38 nt, Artificial Sequence
  Description of Artificial Sequence:  Enzymatic Nucleic Acid
  misc_feature (18)..(25): n stands for any nucleotide and can be optionally absent
ggaguggacugaugaggnnnnnnnnccgaaauagagga

SEQ ID NO: 7057 - RNA, 38 nt, Artificial Sequence
  Description of Artificial Sequence:  Enzymatic Nucleic Acid
  misc_feature (18)..(25): n stands for any nucleotide and can be optionally absent
caggagugcugaugaggnnnnnnnnccgaaagauagag

SEQ ID NO: 7058 - RNA, 38 nt, Artificial Sequence
  Description of Artificial Sequence:  Enzymatic Nucleic Acid
  misc_feature (18)..(25): n stands for any nucleotide and can be optionally absent
ccugacagcugaugaggnnnnnnnnccgaaaguggaga

SEQ ID NO: 7059 - RNA, 38 nt, Artificial Sequence
  Description of Artificial Sequence:  Enzymatic Nucleic Acid
  misc_feature (18)..(25): n stands for any nucleotide and can be optionally absent
gggggccucugaugaggnnnnnnnnccgaaacaggagu

SEQ ID NO: 7060 - RNA, 38 nt, Artificial Sequence
  Description of Artificial Sequence:  Enzymatic Nucleic Acid
  misc_feature (18)..(25): n stands for any nucleotide and can be optionally absent
auacugagcugaugaggnnnnnnnnccgaaacuugggg

SEQ ID NO: 7061 - RNA, 38 nt, Artificial Sequence
  Description of Artificial Sequence:  Enzymatic Nucleic Acid
  misc_feature (18)..(25): n stands for any nucleotide and can be optionally absent
aaaauacucugaugaggnnnnnnnnccgaaaggacuug

SEQ ID NO: 7062 - RNA, 38 nt, Artificial Sequence
  Description of Artificial Sequence:  Enzymatic Nucleic Acid
  misc_feature (18)..(25): n stands for any nucleotide and can be optionally absent
agcuaaaacugaugaggnnnnnnnnccgaaacugagga

SEQ ID NO: 7063 - RNA, 38 nt, Artificial Sequence
  Description of Artificial Sequence:  Enzymatic Nucleic Acid
  misc_feature (18)..(25): n stands for any nucleotide and can be optionally absent
aaagcuaacugaugaggnnnnnnnnccgaaauacugag

SEQ ID NO: 7064 - RNA, 38 nt, Artificial Sequence
  Description of Artificial Sequence:  Enzymatic Nucleic Acid
  misc_feature (18)..(25): n stands for any nucleotide and can be optionally absent
caaagcuacugaugaggnnnnnnnnccgaaaauacuga

SEQ ID NO: 7065 - RNA, 38 nt, Artificial Sequence
  Description of Artificial Sequence:  Enzymatic Nucleic Acid
  misc_feature (18)..(25): n stands for any nucleotide and can be optionally absent
acaaagcucugaugaggnnnnnnnnccgaaaaauacug

SEQ ID NO: 7066 - RNA, 38 nt, Artificial Sequence
  Description of Artificial Sequence:  Enzymatic Nucleic Acid
  misc_feature (18)..(25): n stands for any nucleotide and can be optionally absent
cacaaagccugaugaggnnnnnnnnccgaaaaaauacu

SEQ ID NO: 7067 - RNA, 38 nt, Artificial Sequence
  Description of Artificial Sequence:  Enzymatic Nucleic Acid
  misc_feature (18)..(25): n stands for any nucleotide and can be optionally absent
aagccacacugaugaggnnnnnnnnccgaaagcuaaaa

SEQ ID NO: 7068 - RNA, 38 nt, Artificial Sequence
  Description of Artificial Sequence:  Enzymatic Nucleic Acid
  misc_feature (18)..(25): n stands for any nucleotide and can be optionally absent
gaagccaccugaugaggnnnnnnnnccgaaaagcuaaa

SEQ ID NO: 7069 - RNA, 38 nt, Artificial Sequence
  Description of Artificial Sequence:  Enzymatic Nucleic Acid
  misc_feature (18)..(25): n stands for any nucleotide and can be optionally absent
ccaucaggcugaugaggnnnnnnnnccgaaagccacaa

SEQ ID NO: 7070 - RNA, 38 nt, Artificial Sequence
  Description of Artificial Sequence:  Enzymatic Nucleic Acid
  misc_feature (18)..(25): n stands for any nucleotide and can be optionally absent
gccaucagcugaugaggnnnnnnnnccgaaaagccaca

SEQ ID NO: 7071 - RNA, 38 nt, Artificial Sequence
  Description of Artificial Sequence:  Enzymatic Nucleic Acid
  misc_feature (18)..(25): n stands for any nucleotide and can be optionally absent
ccaauuaacugaugaggnnnnnnnnccgaaauuuuucu

SEQ ID NO: 7072 - RNA, 38 nt, Artificial Sequence
  Description of Artificial Sequence:  Enzymatic Nucleic Acid
  misc_feature (18)..(25): n stands for any nucleotide and can be optionally absent
aaccaauucugaugaggnnnnnnnnccgaaagauuuuu

SEQ ID NO: 7073 - RNA, 38 nt, Artificial Sequence
  Description of Artificial Sequence:  Enzymatic Nucleic Acid
  misc_feature (18)..(25): n stands for any nucleotide and can be optionally absent
caaccaaucugaugaggnnnnnnnnccgaaaagauuuu

SEQ ID NO: 7074 - RNA, 38 nt, Artificial Sequence
  Description of Artificial Sequence:  Enzymatic Nucleic Acid
  misc_feature (18)..(25): n stands for any nucleotide and can be optionally absent
aaccaacccugaugaggnnnnnnnnccgaaauuaagau

SEQ ID NO: 7075 - RNA, 38 nt, Artificial Sequence
  Description of Artificial Sequence:  Enzymatic Nucleic Acid
  misc_feature (18)..(25): n stands for any nucleotide and can be optionally absent
agcaaacccugaugaggnnnnnnnnccgaaaccaauua

SEQ ID NO: 7076 - RNA, 38 nt, Artificial Sequence
  Description of Artificial Sequence:  Enzymatic Nucleic Acid
  misc_feature (18)..(25): n stands for any nucleotide and can be optionally absent
ggagagcacugaugaggnnnnnnnnccgaaaccaacca

SEQ ID NO: 7077 - RNA, 38 nt, Artificial Sequence
  Description of Artificial Sequence:  Enzymatic Nucleic Acid
  misc_feature (18)..(25): n stands for any nucleotide and can be optionally absent
uggagagccugaugaggnnnnnnnnccgaaaaccaacc

SEQ ID NO: 7078 - RNA, 38 nt, Artificial Sequence
  Description of Artificial Sequence:  Enzymatic Nucleic Acid
  misc_feature (18)..(25): n stands for any nucleotide and can be optionally absent
uaucuggacugaugaggnnnnnnnnccgaaagcaaacc

SEQ ID NO: 7079 - RNA, 38 nt, Artificial Sequence
  Description of Artificial Sequence:  Enzymatic Nucleic Acid
  misc_feature (18)..(25): n stands for any nucleotide and can be optionally absent
auuaucugcugaugaggnnnnnnnnccgaaagagcaaa

SEQ ID NO: 7080 - RNA, 38 nt, Artificial Sequence
  Description of Artificial Sequence:  Enzymatic Nucleic Acid
  misc_feature (18)..(25): n stands for any nucleotide and can be optionally absent
cuagugaucugaugaggnnnnnnnnccgaaaucuggag

SEQ ID NO: 7081 - RNA, 38 nt, Artificial Sequence
  Description of Artificial Sequence:  Enzymatic Nucleic Acid
  misc_feature (18)..(25): n stands for any nucleotide and can be optionally absent
uggcuagucugaugaggnnnnnnnnccgaaauuaucug

SEQ ID NO: 7082 - RNA, 38 nt, Artificial Sequence
  Description of Artificial Sequence:  Enzymatic Nucleic Acid
  misc_feature (18)..(25): n stands for any nucleotide and can be optionally absent
aaucuggccugaugaggnnnnnnnnccgaaagugauua

SEQ ID NO: 7083 - RNA, 38 nt, Artificial Sequence
  Description of Artificial Sequence:  Enzymatic Nucleic Acid
  misc_feature (18)..(25): n stands for any nucleotide and can be optionally absent
aauuucgacugaugaggnnnnnnnnccgaaaucuggcu

SEQ ID NO: 7084 - RNA, 38 nt, Artificial Sequence
  Description of Artificial Sequence:  Enzymatic Nucleic Acid
  misc_feature (18)..(25): n stands for any nucleotide and can be optionally absent
uaauuucgcugaugaggnnnnnnnnccgaaaaucuggc

SEQ ID NO: 7085 - RNA, 38 nt, Artificial Sequence
  Description of Artificial Sequence:  Enzymatic Nucleic Acid
  misc_feature (18)..(25): n stands for any nucleotide and can be optionally absent
guaauuuccugaugaggnnnnnnnnccgaaaaaucugg

SEQ ID NO: 7086 - RNA, 38 nt, Artificial Sequence
  Description of Artificial Sequence:  Enzymatic Nucleic Acid
  misc_feature (18)..(25): n stands for any nucleotide and can be optionally absent
uaaaaagucugaugaggnnnnnnnnccgaaauuucgaa

SEQ ID NO: 7087 - RNA, 38 nt, Artificial Sequence
  Description of Artificial Sequence:  Enzymatic Nucleic Acid
  misc_feature (18)..(25): n stands for any nucleotide and can be optionally absent
cuaaaaagcugaugaggnnnnnnnnccgaaaauuucga

SEQ ID NO: 7088 - RNA, 38 nt, Artificial Sequence
  Description of Artificial Sequence:  Enzymatic Nucleic Acid
  misc_feature (18)..(25): n stands for any nucleotide and can be optionally absent
cggcuaaacugaugaggnnnnnnnnccgaaaguaauuu

SEQ ID NO: 7089 - RNA, 38 nt, Artificial Sequence
  Description of Artificial Sequence:  Enzymatic Nucleic Acid
  misc_feature (18)..(25): n stands for any nucleotide and can be optionally absent
ucggcuaacugaugaggnnnnnnnnccgaaaaguaauu

SEQ ID NO: 7090 - RNA, 38 nt, Artificial Sequence
  Description of Artificial Sequence:  Enzymatic Nucleic Acid
  misc_feature (18)..(25): n stands for any nucleotide and can be optionally absent
cucggcuacugaugaggnnnnnnnnccgaaaaaguaau

SEQ ID NO: 7091 - RNA, 38 nt, Artificial Sequence
  Description of Artificial Sequence:  Enzymatic Nucleic Acid
  misc_feature (18)..(25): n stands for any nucleotide and can be optionally absent
ccucggcucugaugaggnnnnnnnnccgaaaaaaguaa

SEQ ID NO: 7092 - RNA, 38 nt, Artificial Sequence
  Description of Artificial Sequence:  Enzymatic Nucleic Acid
  misc_feature (18)..(25): n stands for any nucleotide and can be optionally absent
accucggccugaugaggnnnnnnnnccgaaaaaaagua

SEQ ID NO: 7093 - RNA, 38 nt, Artificial Sequence
  Description of Artificial Sequence:  Enzymatic Nucleic Acid
  misc_feature (18)..(25): n stands for any nucleotide and can be optionally absent
guuaucaucugaugaggnnnnnnnnccgaaaccucggc

SEQ ID NO: 7094 - RNA, 38 nt, Artificial Sequence
  Description of Artificial Sequence:  Enzymatic Nucleic Acid
  misc_feature (18)..(25): n stands for any nucleotide and can be optionally absent
uguuaucacugaugaggnnnnnnnnccgaaaaccucgg

SEQ ID NO: 7095 - RNA, 38 nt, Artificial Sequence
  Description of Artificial Sequence:  Enzymatic Nucleic Acid
  misc_feature (18)..(25): n stands for any nucleotide and can be optionally absent
guagaugucugaugaggnnnnnnnnccgaaaucauaac

SEQ ID NO: 7096 - RNA, 38 nt, Artificial Sequence
  Description of Artificial Sequence:  Enzymatic Nucleic Acid
  misc_feature (18)..(25): n stands for any nucleotide and can be optionally absent
auacaguacugaugaggnnnnnnnnccgaaauguuauc

SEQ ID NO: 7097 - RNA, 38 nt, Artificial Sequence
  Description of Artificial Sequence:  Enzymatic Nucleic Acid
  misc_feature (18)..(25): n stands for any nucleotide and can be optionally absent
ggauacagcugaugaggnnnnnnnnccgaaagauguua

SEQ ID NO: 7098 - RNA, 38 nt, Artificial Sequence
  Description of Artificial Sequence:  Enzymatic Nucleic Acid
  misc_feature (18)..(25): n stands for any nucleotide and can be optionally absent
cuaaaggacugaugaggnnnnnnnnccgaaacaguaga

SEQ ID NO: 7099 - RNA, 38 nt, Artificial Sequence
  Description of Artificial Sequence:  Enzymatic Nucleic Acid
  misc_feature (18)..(25): n stands for any nucleotide and can be optionally absent
uucuaaagcugaugaggnnnnnnnnccgaaauacagua

SEQ ID NO: 7100 - RNA, 38 nt, Artificial Sequence
  Description of Artificial Sequence:  Enzymatic Nucleic Acid
  misc_feature (18)..(25): n stands for any nucleotide and can be optionally absent
aaauucuacugaugaggnnnnnnnnccgaaaggauaca

SEQ ID NO: 7101 - RNA, 38 nt, Artificial Sequence
  Description of Artificial Sequence:  Enzymatic Nucleic Acid
  misc_feature (18)..(25): n stands for any nucleotide and can be optionally absent
aaaauucucugaugaggnnnnnnnnccgaaaaggauac

SEQ ID NO: 7102 - RNA, 38 nt, Artificial Sequence
  Description of Artificial Sequence:  Enzymatic Nucleic Acid
  misc_feature (18)..(25): n stands for any nucleotide and can be optionally absent
uaaaauuccugaugaggnnnnnnnnccgaaaaaggaua

SEQ ID NO: 7103 - RNA, 38 nt, Artificial Sequence
  Description of Artificial Sequence:  Enzymatic Nucleic Acid
  misc_feature (18)..(25): n stands for any nucleotide and can be optionally absent
uagguuaacugaugaggnnnnnnnnccgaaauucuaaa

SEQ ID NO: 7104 - RNA, 38 nt, Artificial Sequence
  Description of Artificial Sequence:  Enzymatic Nucleic Acid
  misc_feature (18)..(25): n stands for any nucleotide and can be optionally absent
auagguuacugaugaggnnnnnnnnccgaaaauucuaa

SEQ ID NO: 7105 - RNA, 38 nt, Artificial Sequence
  Description of Artificial Sequence:  Enzymatic Nucleic Acid
  misc_feature (18)..(25): n stands for any nucleotide and can be optionally absent
uauagguucugaugaggnnnnnnnnccgaaaaauucua

SEQ ID NO: 7106 - RNA, 38 nt, Artificial Sequence
  Description of Artificial Sequence:  Enzymatic Nucleic Acid
  misc_feature (18)..(25): n stands for any nucleotide and can be optionally absent
uuauaggucugaugaggnnnnnnnnccgaaaaaauucu

SEQ ID NO: 7107 - RNA, 38 nt, Artificial Sequence
  Description of Artificial Sequence:  Enzymatic Nucleic Acid
  misc_feature (18)..(25): n stands for any nucleotide and can be optionally absent
uaguuuuacugaugaggnnnnnnnnccgaaagguuaaa

SEQ ID NO: 7108 - RNA, 38 nt, Artificial Sequence
  Description of Artificial Sequence:  Enzymatic Nucleic Acid
  misc_feature (18)..(25): n stands for any nucleotide and can be optionally absent
cauaguuucugaugaggnnnnnnnnccgaaauagguua

SEQ ID NO: 7109 - RNA, 38 nt, Artificial Sequence
  Description of Artificial Sequence:  Enzymatic Nucleic Acid
  misc_feature (18)..(25): n stands for any nucleotide and can be optionally absent
aguagacacugaugaggnnnnnnnnccgaaaguuuuau

SEQ ID NO: 7110 - RNA, 38 nt, Artificial Sequence
  Description of Artificial Sequence:  Enzymatic Nucleic Acid
  misc_feature (18)..(25): n stands for any nucleotide and can be optionally absent
aaccaguacugaugaggnnnnnnnnccgaaacauaguu

SEQ ID NO: 7111 - RNA, 38 nt, Artificial Sequence
  Description of Artificial Sequence:  Enzymatic Nucleic Acid
  misc_feature (18)..(25): n stands for any nucleotide and can be optionally absent
gaaaccagcugaugaggnnnnnnnnccgaaagacauag

SEQ ID NO: 7112 - RNA, 38 nt, Artificial Sequence
  Description of Artificial Sequence:  Enzymatic Nucleic Acid
  misc_feature (18)..(25): n stands for any nucleotide and can be optionally absent
caggcagacugaugaggnnnnnnnnccgaaaccaguag

SEQ ID NO: 7113 - RNA, 38 nt, Artificial Sequence
  Description of Artificial Sequence:  Enzymatic Nucleic Acid
  misc_feature (18)..(25): n stands for any nucleotide and can be optionally absent
acaggcagcugaugaggnnnnnnnnccgaaaaccagua

SEQ ID NO: 7114 - RNA, 38 nt, Artificial Sequence
  Description of Artificial Sequence:  Enzymatic Nucleic Acid
  misc_feature (18)..(25): n stands for any nucleotide and can be optionally absent
cacaggcacugaugaggnnnnnnnnccgaaaaaccagu

SEQ ID NO: 7115 - RNA, 54 nt, Artificial Sequence
  Description of Artificial Sequence:  Enzymatic Nucleic Acid
  misc_feature (18)..(25): n stands for any nucleotide and can be optionally absent
gggacacaagaagggcccaccagagaaacacacguugugguacauuaccuggua

SEQ ID NO: 7116 - RNA, 54 nt, Artificial Sequence
  Description of Artificial Sequence:  Enzymatic Nucleic Acid
  misc_feature (18)..(25): n stands for any nucleotide and can be optionally absent
guuaucccagaagcgggaaccagagaaacacacguugugguacauuaccuggua

SEQ ID NO: 7117 - RNA, 54 nt, Artificial Sequence
  Description of Artificial Sequence:  Enzymatic Nucleic Acid
  misc_feature (18)..(25): n stands for any nucleotide and can be optionally absent
ggaaucggagaagccaggaccagagaaacacacguugugguacauuaccuggua

SEQ ID NO: 7118 - RNA, 54 nt, Artificial Sequence
  Description of Artificial Sequence:  Enzymatic Nucleic Acid
  misc_feature (18)..(25): n stands for any nucleotide and can be optionally absent
uccgcggaagaaggucagaccagagaaacacacguugugguacauuaccuggua

SEQ ID NO: 7119 - RNA, 54 nt, Artificial Sequence
  Description of Artificial Sequence:  Enzymatic Nucleic Acid
  misc_feature (18)..(25): n stands for any nucleotide and can be optionally absent
cggcugucagaaguguccaccagagaaacacacguugugguacauuaccuggua

SEQ ID NO: 7120 - RNA, 54 nt, Artificial Sequence
  Description of Artificial Sequence:  Enzymatic Nucleic Acid
  misc_feature (18)..(25): n stands for any nucleotide and can be optionally absent
ccagccgcagaagucagcaccagagaaacacacguugugguacauuaccuggua

SEQ ID NO: 7121 - RNA, 54 nt, Artificial Sequence
  Description of Artificial Sequence:  Enzymatic Nucleic Acid
  misc_feature (18)..(25): n stands for any nucleotide and can be optionally absent
cuggcuccagaagcggcuaccagagaaacacacguugugguacauuaccuggua

SEQ ID NO: 7122 - RNA, 54 nt, Artificial Sequence
  Description of Artificial Sequence:  Enzymatic Nucleic Acid
  misc_feature (18)..(25): n stands for any nucleotide and can be optionally absent
cagcgcaaagaaggggagaccagagaaacacacguugugguacauuaccuggua

SEQ ID NO: 7123 - RNA, 54 nt, Artificial Sequence
  Description of Artificial Sequence:  Enzymatic Nucleic Acid
  misc_feature (18)..(25): n stands for any nucleotide and can be optionally absent
gucacagaagaaguauggaccagagaaacacacguugugguacauuaccuggua

SEQ ID NO: 7124 - RNA, 54 nt, Artificial Sequence
  Description of Artificial Sequence:  Enzymatic Nucleic Acid
  misc_feature (18)..(25): n stands for any nucleotide and can be optionally absent
cacagagcagaagcuagcaccagagaaacacacguugugguacauuaccuggua

SEQ ID NO: 7125 - RNA, 54 nt, Artificial Sequence
  Description of Artificial Sequence:  Enzymatic Nucleic Acid
  misc_feature (18)..(25): n stands for any nucleotide and can be optionally absent
cccacagaagaagcucggaccagagaaacacacguugugguacauuaccuggua

SEQ ID NO: 7126 - RNA, 54 nt, Artificial Sequence
  Description of Artificial Sequence:  Enzymatic Nucleic Acid
  misc_feature (18)..(25): n stands for any nucleotide and can be optionally absent
ugcaaguaagaagaagggaccagagaaacacacguugugguacauuaccuggua

SEQ ID NO: 7127 - RNA, 54 nt, Artificial Sequence
  Description of Artificial Sequence:  Enzymatic Nucleic Acid
  misc_feature (18)..(25): n stands for any nucleotide and can be optionally absent
uagacauaagaaguggagaccagagaaacacacguugugguacauuaccuggua

SEQ ID NO: 7128 - RNA, 54 nt, Artificial Sequence
  Description of Artificial Sequence:  Enzymatic Nucleic Acid
  misc_feature (18)..(25): n stands for any nucleotide and can be optionally absent
gaauggugagaaguaaucaccagagaaacacacguugugguacauuaccuggua

SEQ ID NO: 7129 - RNA, 54 nt, Artificial Sequence
  Description of Artificial Sequence:  Enzymatic Nucleic Acid
  misc_feature (18)..(25): n stands for any nucleotide and can be optionally absent
cgacccucagaaggggauaccagagaaacacacguugugguacauuaccuggua

SEQ ID NO: 7130 - RNA, 54 nt, Artificial Sequence
  Description of Artificial Sequence:  Enzymatic Nucleic Acid
  misc_feature (18)..(25): n stands for any nucleotide and can be optionally absent
cuguuuccagaaggaacaaccagagaaacacacguugugguacauuaccuggua

SEQ ID NO: 7131 - RNA, 54 nt, Artificial Sequence
  Description of Artificial Sequence:  Enzymatic Nucleic Acid
  misc_feature (18)..(25): n stands for any nucleotide and can be optionally absent
acaugauaagaagauaggaccagagaaacacacguugugguacauuaccuggua

SEQ ID NO: 7132 - RNA, 54 nt, Artificial Sequence
  Description of Artificial Sequence:  Enzymatic Nucleic Acid
  misc_feature (18)..(25): n stands for any nucleotide and can be optionally absent
uuuucuccagaagauagcaccagagaaacacacguugugguacauuaccuggua

SEQ ID NO: 7133 - RNA, 54 nt, Artificial Sequence
  Description of Artificial Sequence:  Enzymatic Nucleic Acid
  misc_feature (18)..(25): n stands for any nucleotide and can be optionally absent
ucuugaucagaaguccacaccagagaaacacacguugugguacauuaccuggua

SEQ ID NO: 7134 - RNA, 54 nt, Artificial Sequence
  Description of Artificial Sequence:  Enzymatic Nucleic Acid
  misc_feature (18)..(25): n stands for any nucleotide and can be optionally absent
auaucaggagaaggguaaaccagagaaacacacguugugguacauuaccuggua

SEQ ID NO: 7135 - RNA, 54 nt, Artificial Sequence
  Description of Artificial Sequence:  Enzymatic Nucleic Acid
  misc_feature (18)..(25): n stands for any nucleotide and can be optionally absent
ucucaccgagaaggggugaccagagaaacacacguugugguacauuaccuggua

SEQ ID NO: 7136 - RNA, 54 nt, Artificial Sequence
  Description of Artificial Sequence:  Enzymatic Nucleic Acid
  misc_feature (18)..(25): n stands for any nucleotide and can be optionally absent
uuggcguaagaagugcauaccagagaaacacacguugugguacauuaccuggua

SEQ ID NO: 7137 - RNA, 54 nt, Artificial Sequence
  Description of Artificial Sequence:  Enzymatic Nucleic Acid
  misc_feature (18)..(25): n stands for any nucleotide and can be optionally absent
ucuguaggagaaggcuucaccagagaaacacacguugugguacauuaccuggua

SEQ ID NO: 7138 - RNA, 54 nt, Artificial Sequence
  Description of Artificial Sequence:  Enzymatic Nucleic Acid
  misc_feature (18)..(25): n stands for any nucleotide and can be optionally absent
uuggccggagaaguaggaaccagagaaacacacguugugguacauuaccuggua

SEQ ID NO: 7139 - RNA, 54 nt, Artificial Sequence
  Description of Artificial Sequence:  Enzymatic Nucleic Acid
  misc_feature (18)..(25): n stands for any nucleotide and can be optionally absent
uuccuucaagaagggcauaccagagaaacacacguugugguacauuaccuggua

SEQ ID NO: 7140 - RNA, 54 nt, Artificial Sequence
  Description of Artificial Sequence:  Enzymatic Nucleic Acid
  misc_feature (18)..(25): n stands for any nucleotide and can be optionally absent
ggcugggcagaagguugcaccagagaaacacacguugugguacauuaccuggua

SEQ ID NO: 7141 - RNA, 54 nt, Artificial Sequence
  Description of Artificial Sequence:  Enzymatic Nucleic Acid
  misc_feature (18)..(25): n stands for any nucleotide and can be optionally absent
guuggcugagaagcagguaccagagaaacacacguugugguacauuaccuggua

SEQ ID NO: 7142 - RNA, 54 nt, Artificial Sequence
  Description of Artificial Sequence:  Enzymatic Nucleic Acid
  misc_feature (18)..(25): n stands for any nucleotide and can be optionally absent
cagugcacagaagggacaaccagagaaacacacguugugguacauuaccuggua

SEQ ID NO: 7143 - RNA, 54 nt, Artificial Sequence
  Description of Artificial Sequence:  Enzymatic Nucleic Acid
  misc_feature (18)..(25): n stands for any nucleotide and can be optionally absent
cccaugugagaagauguuaccagagaaacacacguugugguacauuaccuggua

SEQ ID NO: 7144 - RNA, 54 nt, Artificial Sequence
  Description of Artificial Sequence:  Enzymatic Nucleic Acid
  misc_feature (18)..(25): n stands for any nucleotide and can be optionally absent
uuaucuugagaagagcaaaccagagaaacacacguugugguacauuaccuggua

SEQ ID NO: 7145 - RNA, 54 nt, Artificial Sequence
  Description of Artificial Sequence:  Enzymatic Nucleic Acid
  misc_feature (18)..(25): n stands for any nucleotide and can be optionally absent
ggaugaugagaaguuugaaccagagaaacacacguugugguacauuaccuggua

SEQ ID NO: 7146 - RNA, 54 nt, Artificial Sequence
  Description of Artificial Sequence:  Enzymatic Nucleic Acid
  misc_feature (18)..(25): n stands for any nucleotide and can be optionally absent
ugcggauaagaagguuccaccagagaaacacacguugugguacauuaccuggua

SEQ ID NO: 7147 - RNA, 54 nt, Artificial Sequence
  Description of Artificial Sequence:  Enzymatic Nucleic Acid
  misc_feature (18)..(25): n stands for any nucleotide and can be optionally absent
gcuuaacgagaaguaggaaccagagaaacacacguugugguacauuaccuggua

SEQ ID NO: 7148 - RNA, 54 nt, Artificial Sequence
  Description of Artificial Sequence:  Enzymatic Nucleic Acid
  misc_feature (18)..(25): n stands for any nucleotide and can be optionally absent
ggcaauucagaaggauccaccagagaaacacacguugugguacauuaccuggua

SEQ ID NO: 7149 - RNA, 54 nt, Artificial Sequence
  Description of Artificial Sequence:  Enzymatic Nucleic Acid
  misc_feature (18)..(25): n stands for any nucleotide and can be optionally absent
cuaguuucagaaggucccaccagagaaacacacguugugguacauuaccuggua

SEQ ID NO: 7150 - RNA, 54 nt, Artificial Sequence
  Description of Artificial Sequence:  Enzymatic Nucleic Acid
  misc_feature (18)..(25): n stands for any nucleotide and can be optionally absent
ccaaaagcagaagccucaaccagagaaacacacguugugguacauuaccuggua

SEQ ID NO: 7151 - RNA, 54 nt, Artificial Sequence
  Description of Artificial Sequence:  Enzymatic Nucleic Acid
  misc_feature (18)..(25): n stands for any nucleotide and can be optionally absent
aaagccugagaaggcagaaccagagaaacacacguugugguacauuaccuggua

SEQ ID NO: 7152 - RNA, 54 nt, Artificial Sequence
  Description of Artificial Sequence:  Enzymatic Nucleic Acid
  misc_feature (18)..(25): n stands for any nucleotide and can be optionally absent
ccgggccaagaagaagucaccagagaaacacacguugugguacauuaccuggua

SEQ ID NO: 7153 - RNA, 54 nt, Artificial Sequence
  Description of Artificial Sequence:  Enzymatic Nucleic Acid
  misc_feature (18)..(25): n stands for any nucleotide and can be optionally absent
cugacauaagaagggucuaccagagaaacacacguugugguacauuaccuggua

SEQ ID NO: 7154 - RNA, 54 nt, Artificial Sequence
  Description of Artificial Sequence:  Enzymatic Nucleic Acid
  misc_feature (18)..(25): n stands for any nucleotide and can be optionally absent
caaagggaagaaggcaucaccagagaaacacacguugugguacauuaccuggua

SEQ ID NO: 7155 - RNA, 54 nt, Artificial Sequence
  Description of Artificial Sequence:  Enzymatic Nucleic Acid
  misc_feature (18)..(25): n stands for any nucleotide and can be optionally absent
guaguguaagaaggagccaccagagaaacacacguugugguacauuaccuggua

SEQ ID NO: 7156 - RNA, 54 nt, Artificial Sequence
  Description of Artificial Sequence:  Enzymatic Nucleic Acid
  misc_feature (18)..(25): n stands for any nucleotide and can be optionally absent
cucaugccagaaguccagaccagagaaacacacguugugguacauuaccuggua

SEQ ID NO: 7157 - RNA, 54 nt, Artificial Sequence
  Description of Artificial Sequence:  Enzymatic Nucleic Acid
  misc_feature (18)..(25): n stands for any nucleotide and can be optionally absent
gugagguaagaagggagaaccagagaaacacacguugugguacauuaccuggua

SEQ ID NO: 7158 - RNA, 54 nt, Artificial Sequence
  Description of Artificial Sequence:  Enzymatic Nucleic Acid
  misc_feature (18)..(25): n stands for any nucleotide and can be optionally absent
uggcugucagaagggaucaccagagaaacacacguugugguacauuaccuggua

SEQ ID NO: 7159 - RNA, 54 nt, Artificial Sequence
  Description of Artificial Sequence:  Enzymatic Nucleic Acid
  misc_feature (18)..(25): n stands for any nucleotide and can be optionally absent
agccacugagaagguuggaccagagaaacacacguugugguacauuaccuggua

SEQ ID NO: 7160 - RNA, 54 nt, Artificial Sequence
  Description of Artificial Sequence:  Enzymatic Nucleic Acid
  misc_feature (18)..(25): n stands for any nucleotide and can be optionally absent
gauacccaagaagguagcaccagagaaacacacguugugguacauuaccuggua

SEQ ID NO: 7161 - RNA, 54 nt, Artificial Sequence
  Description of Artificial Sequence:  Enzymatic Nucleic Acid
  misc_feature (18)..(25): n stands for any nucleotide and can be optionally absent
ucagcgugagaagcagcaaccagagaaacacacguugugguacauuaccuggua

SEQ ID NO: 7162 - RNA, 54 nt, Artificial Sequence
  Description of Artificial Sequence:  Enzymatic Nucleic Acid
  misc_feature (18)..(25): n stands for any nucleotide and can be optionally absent
gucccugaagaagcgugaaccagagaaacacacguugugguacauuaccuggua

SEQ ID NO: 7163 - RNA, 54 nt, Artificial Sequence
  Description of Artificial Sequence:  Enzymatic Nucleic Acid
  misc_feature (18)..(25): n stands for any nucleotide and can be optionally absent
aggaggugagaagcagugaccagagaaacacacguugugguacauuaccuggua

SEQ ID NO: 7164 - RNA, 54 nt, Artificial Sequence
  Description of Artificial Sequence:  Enzymatic Nucleic Acid
  misc_feature (18)..(25): n stands for any nucleotide and can be optionally absent
uccauuuaagaaggagguaccagagaaacacacguugugguacauuaccuggua

SEQ ID NO: 7165 - RNA, 54 nt, Artificial Sequence
  Description of Artificial Sequence:  Enzymatic Nucleic Acid
  misc_feature (18)..(25): n stands for any nucleotide and can be optionally absent
ggagccggagaaggaccaaccagagaaacacacguugugguacauuaccuggua

SEQ ID NO: 7166 - RNA, 54 nt, Artificial Sequence
  Description of Artificial Sequence:  Enzymatic Nucleic Acid
  misc_feature (18)..(25): n stands for any nucleotide and can be optionally absent
gggggcggagaagggacaaccagagaaacacacguugugguacauuaccuggua

SEQ ID NO: 7167 - RNA, 54 nt, Artificial Sequence
  Description of Artificial Sequence:  Enzymatic Nucleic Acid
  misc_feature (18)..(25): n stands for any nucleotide and can be optionally absent
gaguugggagaagagccgaccagagaaacacacguugugguacauuaccuggua

SEQ ID NO: 7168 - RNA, 54 nt, Artificial Sequence
  Description of Artificial Sequence:  Enzymatic Nucleic Acid
  misc_feature (18)..(25): n stands for any nucleotide and can be optionally absent
aaaaucuaagaagcaccuaccagagaaacacacguugugguacauuaccuggua

SEQ ID NO: 7169 - RNA, 54 nt, Artificial Sequence
  Description of Artificial Sequence:  Enzymatic Nucleic Acid
  misc_feature (18)..(25): n stands for any nucleotide and can be optionally absent
uccuugcaagaagaggucaccagagaaacacacguugugguacauuaccuggua

SEQ ID NO: 7170 - RNA, 54 nt, Artificial Sequence
  Description of Artificial Sequence:  Enzymatic Nucleic Acid
  misc_feature (18)..(25): n stands for any nucleotide and can be optionally absent
gagaccacagaagggcacaccagagaaacacacguugugguacauuaccuggua

SEQ ID NO: 7171 - RNA, 54 nt, Artificial Sequence
  Description of Artificial Sequence:  Enzymatic Nucleic Acid
  misc_feature (18)..(25): n stands for any nucleotide and can be optionally absent
ucuuggagagaagaguccaccagagaaacacacguugugguacauuaccuggua

SEQ ID NO: 7172 - RNA, 54 nt, Artificial Sequence
  Description of Artificial Sequence:  Enzymatic Nucleic Acid
  misc_feature (18)..(25): n stands for any nucleotide and can be optionally absent
ccaagguaagaagacucgaccagagaaacacacguugugguacauuaccuggua

SEQ ID NO: 7173 - RNA, 54 nt, Artificial Sequence
  Description of Artificial Sequence:  Enzymatic Nucleic Acid
  misc_feature (18)..(25): n stands for any nucleotide and can be optionally absent
caggcuccagaagcucucaccagagaaacacacguugugguacauuaccuggua

SEQ ID NO: 7174 - RNA, 54 nt, Artificial Sequence
  Description of Artificial Sequence:  Enzymatic Nucleic Acid
  misc_feature (18)..(25): n stands for any nucleotide and can be optionally absent
cacaaugcagaagcaggcaccagagaaacacacguugugguacauuaccuggua

SEQ ID NO: 7175 - RNA, 54 nt, Artificial Sequence
  Description of Artificial Sequence:  Enzymatic Nucleic Acid
  misc_feature (18)..(25): n stands for any nucleotide and can be optionally absent
acccugccagaagccuuuaccagagaaacacacguugugguacauuaccuggua

SEQ ID NO: 7176 - RNA, 54 nt, Artificial Sequence
  Description of Artificial Sequence:  Enzymatic Nucleic Acid
  misc_feature (18)..(25): n stands for any nucleotide and can be optionally absent
uguaacccagaagugaagaccagagaaacacacguugugguacauuaccuggua

SEQ ID NO: 7177 - RNA, 54 nt, Artificial Sequence
  Description of Artificial Sequence:  Enzymatic Nucleic Acid
  misc_feature (18)..(25): n stands for any nucleotide and can be optionally absent
acguaagaagaaggaaggaccagagaaacacacguugugguacauuaccuggua

SEQ ID NO: 7178 - RNA, 54 nt, Artificial Sequence
  Description of Artificial Sequence:  Enzymatic Nucleic Acid
  misc_feature (18)..(25): n stands for any nucleotide and can be optionally absent
aaggagcaagaagcaucaaccagagaaacacacguugugguacauuaccuggua

SEQ ID NO: 7179 - RNA, 54 nt, Artificial Sequence
  Description of Artificial Sequence:  Enzymatic Nucleic Acid
  misc_feature (18)..(25): n stands for any nucleotide and can be optionally absent
ucggccccagaaggagccaccagagaaacacacguugugguacauuaccuggua

SEQ ID NO: 7180 - RNA, 54 nt, Artificial Sequence
  Description of Artificial Sequence:  Enzymatic Nucleic Acid
  misc_feature (18)..(25): n stands for any nucleotide and can be optionally absent
cuccacccagaagaaaccaccagagaaacacacguugugguacauuaccuggua

SEQ ID NO: 7181 - RNA, 54 nt, Artificial Sequence
  Description of Artificial Sequence:  Enzymatic Nucleic Acid
  misc_feature (18)..(25): n stands for any nucleotide and can be optionally absent
uuucugccagaaggaagcaccagagaaacacacguugugguacauuaccuggua

SEQ ID NO: 7182 - RNA, 54 nt, Artificial Sequence
  Description of Artificial Sequence:  Enzymatic Nucleic Acid
  misc_feature (18)..(25): n stands for any nucleotide and can be optionally absent
auuucgaaagaaggcuagaccagagaaacacacguugugguacauuaccuggua

SEQ ID NO: 7183 - RNA, 54 nt, Artificial Sequence
  Description of Artificial Sequence:  Enzymatic Nucleic Acid
  misc_feature (18)..(25): n stands for any nucleotide and can be optionally absent
agcacacaagaagaaaccaccagagaaacacacguugugguacauuaccuggua

SEQ ID NO: 7184 - RNA, 38 nt, Artificial Sequence
  Description of Artificial Sequence:  Enzymatic Nucleic Acid
  misc_feature (18)..(25): n stands for any nucleotide and can be optionally absent
gugagcaacugaugaggnnnnnnnnccgaaacgcggcc

SEQ ID NO: 7185 - RNA, 38 nt, Artificial Sequence
  Description of Artificial Sequence:  Enzymatic Nucleic Acid
  misc_feature (18)..(25): n stands for any nucleotide and can be optionally absent
uggugagccugaugaggnnnnnnnnccgaaagacgcgg

SEQ ID NO: 7186 - RNA, 38 nt, Artificial Sequence
  Description of Artificial Sequence:  Enzymatic Nucleic Acid
  misc_feature (18)..(25): n stands for any nucleotide and can be optionally absent
accauggucugaugaggnnnnnnnnccgaaagcaagac

SEQ ID NO: 7187 - RNA, 38 nt, Artificial Sequence
  Description of Artificial Sequence:  Enzymatic Nucleic Acid
  misc_feature (18)..(25): n stands for any nucleotide and can be optionally absent
cagcagcucugaugaggnnnnnnnnccgaaaccauggu

SEQ ID NO: 7188 - RNA, 38 nt, Artificial Sequence
  Description of Artificial Sequence:  Enzymatic Nucleic Acid
  misc_feature (18)..(25): n stands for any nucleotide and can be optionally absent
uaaggcaacugaugaggnnnnnnnnccgaaaccgcggu

SEQ ID NO: 7189 - RNA, 38 nt, Artificial Sequence
  Description of Artificial Sequence:  Enzymatic Nucleic Acid
  misc_feature (18)..(25): n stands for any nucleotide and can be optionally absent
cguaaggccugaugaggnnnnnnnnccgaaagaccgcg

SEQ ID NO: 7190 - RNA, 38 nt, Artificial Sequence
  Description of Artificial Sequence:  Enzymatic Nucleic Acid
  misc_feature (18)..(25): n stands for any nucleotide and can be optionally absent
cagcgcgucugaugaggnnnnnnnnccgaaaggcaaga

SEQ ID NO: 7191 - RNA, 38 nt, Artificial Sequence
  Description of Artificial Sequence:  Enzymatic Nucleic Acid
  misc_feature (18)..(25): n stands for any nucleotide and can be optionally absent
gcagcgcgcugaugaggnnnnnnnnccgaaaaggcaag

SEQ ID NO: 7192 - RNA, 38 nt, Artificial Sequence
  Description of Artificial Sequence:  Enzymatic Nucleic Acid
  misc_feature (18)..(25): n stands for any nucleotide and can be optionally absent
agacaccccugaugaggnnnnnnnnccgaaagcagcgc

SEQ ID NO: 7193 - RNA, 38 nt, Artificial Sequence
  Description of Artificial Sequence:  Enzymatic Nucleic Acid
  misc_feature (18)..(25): n stands for any nucleotide and can be optionally absent
gagaagcacugaugaggnnnnnnnnccgaaacacccga

SEQ ID NO: 7194 - RNA, 38 nt, Artificial Sequence
  Description of Artificial Sequence:  Enzymatic Nucleic Acid
  misc_feature (18)..(25): n stands for any nucleotide and can be optionally absent
uauccugucugaugaggnnnnnnnnccgaaagaagcag

SEQ ID NO: 7195 - RNA, 38 nt, Artificial Sequence
  Description of Artificial Sequence:  Enzymatic Nucleic Acid
  misc_feature (18)..(25): n stands for any nucleotide and can be optionally absent
cugagccacugaugaggnnnnnnnnccgaaauccugug

SEQ ID NO: 7196 - RNA, 38 nt, Artificial Sequence
  Description of Artificial Sequence:  Enzymatic Nucleic Acid
  misc_feature (18)..(25): n stands for any nucleotide and can be optionally absent
ucgacccucugaugaggnnnnnnnnccgaaagccauau

SEQ ID NO: 7197 - RNA, 38 nt, Artificial Sequence
  Description of Artificial Sequence:  Enzymatic Nucleic Acid
  misc_feature (18)..(25): n stands for any nucleotide and can be optionally absent
uuaacuuccugaugaggnnnnnnnnccgaaacccugag

SEQ ID NO: 7198 - RNA, 38 nt, Artificial Sequence
  Description of Artificial Sequence:  Enzymatic Nucleic Acid
  misc_feature (18)..(25): n stands for any nucleotide and can be optionally absent
gcacuuuucugaugaggnnnnnnnnccgaaacuucgac

SEQ ID NO: 7199 - RNA, 38 nt, Artificial Sequence
  Description of Artificial Sequence:  Enzymatic Nucleic Acid
  misc_feature (18)..(25): n stands for any nucleotide and can be optionally absent
ggcacuuucugaugaggnnnnnnnnccgaaaacuucga

SEQ ID NO: 7200 - RNA, 38 nt, Artificial Sequence
  Description of Artificial Sequence:  Enzymatic Nucleic Acid
  misc_feature (18)..(25): n stands for any nucleotide and can be optionally absent
gcuugcaucugaugaggnnnnnnnnccgaaacaugcug

SEQ ID NO: 7201 - RNA, 38 nt, Artificial Sequence
  Description of Artificial Sequence:  Enzymatic Nucleic Acid
  misc_feature (18)..(25): n stands for any nucleotide and can be optionally absent
gagaaagacugaugaggnnnnnnnnccgaaagucuggc

SEQ ID NO: 7202 - RNA, 38 nt, Artificial Sequence
  Description of Artificial Sequence:  Enzymatic Nucleic Acid
  misc_feature (18)..(25): n stands for any nucleotide and can be optionally absent
uugagaaacugaugaggnnnnnnnnccgaaagagucug

SEQ ID NO: 7203 - RNA, 38 nt, Artificial Sequence
  Description of Artificial Sequence:  Enzymatic Nucleic Acid
  misc_feature (18)..(25): n stands for any nucleotide and can be optionally absent
acuugagacugaugaggnnnnnnnnccgaaagagaguc

SEQ ID NO: 7204 - RNA, 38 nt, Artificial Sequence
  Description of Artificial Sequence:  Enzymatic Nucleic Acid
  misc_feature (18)..(25): n stands for any nucleotide and can be optionally absent
cacuugagcugaugaggnnnnnnnnccgaaaagagagu

SEQ ID NO: 7205 - RNA, 38 nt, Artificial Sequence
  Description of Artificial Sequence:  Enzymatic Nucleic Acid
  misc_feature (18)..(25): n stands for any nucleotide and can be optionally absent
gcacuugacugaugaggnnnnnnnnccgaaaaagagag

SEQ ID NO: 7206 - RNA, 38 nt, Artificial Sequence
  Description of Artificial Sequence:  Enzymatic Nucleic Acid
  misc_feature (18)..(25): n stands for any nucleotide and can be optionally absent
cugcacuucugaugaggnnnnnnnnccgaaagaaagag

SEQ ID NO: 7207 - RNA, 38 nt, Artificial Sequence
  Description of Artificial Sequence:  Enzymatic Nucleic Acid
  misc_feature (18)..(25): n stands for any nucleotide and can be optionally absent
gagaccaucugaugaggnnnnnnnnccgaaagugggcu

SEQ ID NO: 7208 - RNA, 38 nt, Artificial Sequence
  Description of Artificial Sequence:  Enzymatic Nucleic Acid
  misc_feature (18)..(25): n stands for any nucleotide and can be optionally absent
ugggcagacugaugaggnnnnnnnnccgaaaccaugag

SEQ ID NO: 7209 - RNA, 38 nt, Artificial Sequence
  Description of Artificial Sequence:  Enzymatic Nucleic Acid
  misc_feature (18)..(25): n stands for any nucleotide and can be optionally absent
cgugggcacugaugaggnnnnnnnnccgaaagaccaug

SEQ ID NO: 7210 - RNA, 38 nt, Artificial Sequence
  Description of Artificial Sequence:  Enzymatic Nucleic Acid
  misc_feature (18)..(25): n stands for any nucleotide and can be optionally absent
gggggagucugaugaggnnnnnnnnccgaaaugcucag

SEQ ID NO: 7211 - RNA, 38 nt, Artificial Sequence
  Description of Artificial Sequence:  Enzymatic Nucleic Acid
  misc_feature (18)..(25): n stands for any nucleotide and can be optionally absent
cgauggggcugaugaggnnnnnnnnccgaaagugaugc

SEQ ID NO: 7212 - RNA, 38 nt, Artificial Sequence
  Description of Artificial Sequence:  Enzymatic Nucleic Acid
  misc_feature (18)..(25): n stands for any nucleotide and can be optionally absent
cacaggcccugaugaggnnnnnnnnccgaaauggggga

SEQ ID NO: 7213 - RNA, 38 nt, Artificial Sequence
  Description of Artificial Sequence:  Enzymatic Nucleic Acid
  misc_feature (18)..(25): n stands for any nucleotide and can be optionally absent
uugccugucugaugaggnnnnnnnnccgaaaucccucc

SEQ ID NO: 7214 - RNA, 38 nt, Artificial Sequence
  Description of Artificial Sequence:  Enzymatic Nucleic Acid
  misc_feature (18)..(25): n stands for any nucleotide and can be optionally absent
ugcugcagcugaugaggnnnnnnnnccgaaauugccug

SEQ ID NO: 7215 - RNA, 38 nt, Artificial Sequence
  Description of Artificial Sequence:  Enzymatic Nucleic Acid
  misc_feature (18)..(25): n stands for any nucleotide and can be optionally absent
gugcugcacugaugaggnnnnnnnnccgaaaauugccu

SEQ ID NO: 7216 - RNA, 38 nt, Artificial Sequence
  Description of Artificial Sequence:  Enzymatic Nucleic Acid
  misc_feature (18)..(25): n stands for any nucleotide and can be optionally absent
ccaagguccugaugaggnnnnnnnnccgaaaggugcug

SEQ ID NO: 7217 - RNA, 38 nt, Artificial Sequence
  Description of Artificial Sequence:  Enzymatic Nucleic Acid
  misc_feature (18)..(25): n stands for any nucleotide and can be optionally absent
ccgugucccugaugaggnnnnnnnnccgaaaggucaag

SEQ ID NO: 7218 - RNA, 38 nt, Artificial Sequence
  Description of Artificial Sequence:  Enzymatic Nucleic Acid
  misc_feature (18)..(25): n stands for any nucleotide and can be optionally absent
cagguguacugaugaggnnnnnnnnccgaaaggcccgu

SEQ ID NO: 7219 - RNA, 38 nt, Artificial Sequence
  Description of Artificial Sequence:  Enzymatic Nucleic Acid
  misc_feature (18)..(25): n stands for any nucleotide and can be optionally absent
uacaggugcugaugaggnnnnnnnnccgaaagaggccc

SEQ ID NO: 7220 - RNA, 38 nt, Artificial Sequence
  Description of Artificial Sequence:  Enzymatic Nucleic Acid
  misc_feature (18)..(25): n stands for any nucleotide and can be optionally absent
gagguauccugaugaggnnnnnnnnccgaaacaggugu

SEQ ID NO: 7221 - RNA, 38 nt, Artificial Sequence
  Description of Artificial Sequence:  Enzymatic Nucleic Acid
  misc_feature (18)..(25): n stands for any nucleotide and can be optionally absent
uagggaggcugaugaggnnnnnnnnccgaaaucuacag

SEQ ID NO: 7222 - RNA, 38 nt, Artificial Sequence
  Description of Artificial Sequence:  Enzymatic Nucleic Acid
  misc_feature (18)..(25): n stands for any nucleotide and can be optionally absent
gauguaggcugaugaggnnnnnnnnccgaaagguaucu

SEQ ID NO: 7223 - RNA, 38 nt, Artificial Sequence
  Description of Artificial Sequence:  Enzymatic Nucleic Acid
  misc_feature (18)..(25): n stands for any nucleotide and can be optionally absent
aguagaugcugaugaggnnnnnnnnccgaaagggaggu

SEQ ID NO: 7224 - RNA, 38 nt, Artificial Sequence
  Description of Artificial Sequence:  Enzymatic Nucleic Acid
  misc_feature (18)..(25): n stands for any nucleotide and can be optionally absent
ucgaaguacugaugaggnnnnnnnnccgaaauguaggg

SEQ ID NO: 7225 - RNA, 38 nt, Artificial Sequence
  Description of Artificial Sequence:  Enzymatic Nucleic Acid
  misc_feature (18)..(25): n stands for any nucleotide and can be optionally absent
cuucgaagcugaugaggnnnnnnnnccgaaagauguag

SEQ ID NO: 7226 - RNA, 38 nt, Artificial Sequence
  Description of Artificial Sequence:  Enzymatic Nucleic Acid
  misc_feature (18)..(25): n stands for any nucleotide and can be optionally absent
uuucuucgcugaugaggnnnnnnnnccgaaaguagaug

SEQ ID NO: 7227 - RNA, 38 nt, Artificial Sequence
  Description of Artificial Sequence:  Enzymatic Nucleic Acid
  misc_feature (18)..(25): n stands for any nucleotide and can be optionally absent
uuuucuuccugaugaggnnnnnnnnccgaaaaguagau

SEQ ID NO: 7228 - RNA, 38 nt, Artificial Sequence
  Description of Artificial Sequence:  Enzymatic Nucleic Acid
  misc_feature (18)..(25): n stands for any nucleotide and can be optionally absent
agauugaacugaugaggnnnnnnnnccgaaauuccgcu

SEQ ID NO: 7229 - RNA, 38 nt, Artificial Sequence
  Description of Artificial Sequence:  Enzymatic Nucleic Acid
  misc_feature (18)..(25): n stands for any nucleotide and can be optionally absent
guagauugcugaugaggnnnnnnnnccgaaagauuccg

SEQ ID NO: 7230 - RNA, 38 nt, Artificial Sequence
  Description of Artificial Sequence:  Enzymatic Nucleic Acid
  misc_feature (18)..(25): n stands for any nucleotide and can be optionally absent
uguagauucugaugaggnnnnnnnnccgaaaagauucc

SEQ ID NO: 7231 - RNA, 38 nt, Artificial Sequence
  Description of Artificial Sequence:  Enzymatic Nucleic Acid
  misc_feature (18)..(25): n stands for any nucleotide and can be optionally absent
aauauguacugaugaggnnnnnnnnccgaaauugaaga

SEQ ID NO: 7232 - RNA, 38 nt, Artificial Sequence
  Description of Artificial Sequence:  Enzymatic Nucleic Acid
  misc_feature (18)..(25): n stands for any nucleotide and can be optionally absent
caaauaugcugaugaggnnnnnnnnccgaaagauugaa

SEQ ID NO: 7233 - RNA, 38 nt, Artificial Sequence
  Description of Artificial Sequence:  Enzymatic Nucleic Acid
  misc_feature (18)..(25): n stands for any nucleotide and can be optionally absent
cuaacaaacugaugaggnnnnnnnnccgaaauguagau

SEQ ID NO: 7234 - RNA, 38 nt, Artificial Sequence
  Description of Artificial Sequence:  Enzymatic Nucleic Acid
  misc_feature (18)..(25): n stands for any nucleotide and can be optionally absent
cacuaacacugaugaggnnnnnnnnccgaaauauguag

SEQ ID NO: 7235 - RNA, 38 nt, Artificial Sequence
  Description of Artificial Sequence:  Enzymatic Nucleic Acid
  misc_feature (18)..(25): n stands for any nucleotide and can be optionally absent
ucacuaaccugaugaggnnnnnnnnccgaaaauaugua

SEQ ID NO: 7236 - RNA, 38 nt, Artificial Sequence
  Description of Artificial Sequence:  Enzymatic Nucleic Acid
  misc_feature (18)..(25): n stands for any nucleotide and can be optionally absent
gcaucacucugaugaggnnnnnnnnccgaaacaaauau

SEQ ID NO: 7237 - RNA, 38 nt, Artificial Sequence
  Description of Artificial Sequence:  Enzymatic Nucleic Acid
  misc_feature (18)..(25): n stands for any nucleotide and can be optionally absent
ugcaucaccugaugaggnnnnnnnnccgaaaacaaaua

SEQ ID NO: 7238 - RNA, 38 nt, Artificial Sequence
  Description of Artificial Sequence:  Enzymatic Nucleic Acid
  misc_feature (18)..(25): n stands for any nucleotide and can be optionally absent
uaugaaagcugaugaggnnnnnnnnccgaaacucccug

SEQ ID NO: 7239 - RNA, 38 nt, Artificial Sequence
  Description of Artificial Sequence:  Enzymatic Nucleic Acid
  misc_feature (18)..(25): n stands for any nucleotide and can be optionally absent
cucuaugacugaugaggnnnnnnnnccgaaaggacucc

SEQ ID NO: 7240 - RNA, 38 nt, Artificial Sequence
  Description of Artificial Sequence:  Enzymatic Nucleic Acid
  misc_feature (18)..(25): n stands for any nucleotide and can be optionally absent
ucucuaugcugaugaggnnnnnnnnccgaaaaggacuc

SEQ ID NO: 7241 - RNA, 38 nt, Artificial Sequence
  Description of Artificial Sequence:  Enzymatic Nucleic Acid
  misc_feature (18)..(25): n stands for any nucleotide and can be optionally absent
aucucuaucugaugaggnnnnnnnnccgaaaaaggacu

SEQ ID NO: 7242 - RNA, 38 nt, Artificial Sequence
  Description of Artificial Sequence:  Enzymatic Nucleic Acid
  misc_feature (18)..(25): n stands for any nucleotide and can be optionally absent
ugcaucuccugaugaggnnnnnnnnccgaaaugaaagg

SEQ ID NO: 7243 - RNA, 38 nt, Artificial Sequence
  Description of Artificial Sequence:  Enzymatic Nucleic Acid
  misc_feature (18)..(25): n stands for any nucleotide and can be optionally absent
aguuugggcugaugaggnnnnnnnnccgaaaugucagu

SEQ ID NO: 7244 - RNA, 38 nt, Artificial Sequence
  Description of Artificial Sequence:  Enzymatic Nucleic Acid
  misc_feature (18)..(25): n stands for any nucleotide and can be optionally absent
augugcaccugaugaggnnnnnnnnccgaaaguuuggg

SEQ ID NO: 7245 - RNA, 38 nt, Artificial Sequence
  Description of Artificial Sequence:  Enzymatic Nucleic Acid
  misc_feature (18)..(25): n stands for any nucleotide and can be optionally absent
gggaugaucugaugaggnnnnnnnnccgaaagcugucu

SEQ ID NO: 7246 - RNA, 38 nt, Artificial Sequence
  Description of Artificial Sequence:  Enzymatic Nucleic Acid
  misc_feature (18)..(25): n stands for any nucleotide and can be optionally absent
caggggaucugaugaggnnnnnnnnccgaaaugagcug

SEQ ID NO: 7247 - RNA, 38 nt, Artificial Sequence
  Description of Artificial Sequence:  Enzymatic Nucleic Acid
  misc_feature (18)..(25): n stands for any nucleotide and can be optionally absent
cggcagggcugaugaggnnnnnnnnccgaaaugaugag

SEQ ID NO: 7248 - RNA, 38 nt, Artificial Sequence
  Description of Artificial Sequence:  Enzymatic Nucleic Acid
  misc_feature (18)..(25): n stands for any nucleotide and can be optionally absent
cguugggucugaugaggnnnnnnnnccgaaacgucacc

SEQ ID NO: 7249 - RNA, 38 nt, Artificial Sequence
  Description of Artificial Sequence:  Enzymatic Nucleic Acid
  misc_feature (18)..(25): n stands for any nucleotide and can be optionally absent
gugacugucugaugaggnnnnnnnnccgaaacguuggg

SEQ ID NO: 7250 - RNA, 38 nt, Artificial Sequence
  Description of Artificial Sequence:  Enzymatic Nucleic Acid
  misc_feature (18)..(25): n stands for any nucleotide and can be optionally absent
uuuagggucugaugaggnnnnnnnnccgaaacugugac

SEQ ID NO: 7251 - RNA, 38 nt, Artificial Sequence
  Description of Artificial Sequence:  Enzymatic Nucleic Acid
  misc_feature (18)..(25): n stands for any nucleotide and can be optionally absent
aacuuuuucugaugaggnnnnnnnnccgaaagggugac

SEQ ID NO: 7252 - RNA, 38 nt, Artificial Sequence
  Description of Artificial Sequence:  Enzymatic Nucleic Acid
  misc_feature (18)..(25): n stands for any nucleotide and can be optionally absent
caaauggacugaugaggnnnnnnnnccgaaacuuuuuu

SEQ ID NO: 7253 - RNA, 38 nt, Artificial Sequence
  Description of Artificial Sequence:  Enzymatic Nucleic Acid
  misc_feature (18)..(25): n stands for any nucleotide and can be optionally absent
ucaaauggcugaugaggnnnnnnnnccgaaaacuuuuu

SEQ ID NO: 7254 - RNA, 38 nt, Artificial Sequence
  Description of Artificial Sequence:  Enzymatic Nucleic Acid
  misc_feature (18)..(25): n stands for any nucleotide and can be optionally absent
aucaaaugcugaugaggnnnnnnnnccgaaaaacuuuu

SEQ ID NO: 7255 - RNA, 38 nt, Artificial Sequence
  Description of Artificial Sequence:  Enzymatic Nucleic Acid
  misc_feature (18)..(25): n stands for any nucleotide and can be optionally absent
gaguaucacugaugaggnnnnnnnnccgaaauggaaac

SEQ ID NO: 7256 - RNA, 38 nt, Artificial Sequence
  Description of Artificial Sequence:  Enzymatic Nucleic Acid
  misc_feature (18)..(25): n stands for any nucleotide and can be optionally absent
agaguauccugaugaggnnnnnnnnccgaaaauggaaa

SEQ ID NO: 7257 - RNA, 38 nt, Artificial Sequence
  Description of Artificial Sequence:  Enzymatic Nucleic Acid
  misc_feature (18)..(25): n stands for any nucleotide and can be optionally absent
gguaagagcugaugaggnnnnnnnnccgaaaucaaaug

SEQ ID NO: 7258 - RNA, 38 nt, Artificial Sequence
  Description of Artificial Sequence:  Enzymatic Nucleic Acid
  misc_feature (18)..(25): n stands for any nucleotide and can be optionally absent
agggguaacugaugaggnnnnnnnnccgaaaguaucaa

SEQ ID NO: 7259 - RNA, 38 nt, Artificial Sequence
  Description of Artificial Sequence:  Enzymatic Nucleic Acid
  misc_feature (18)..(25): n stands for any nucleotide and can be optionally absent
ucaggggucugaugaggnnnnnnnnccgaaagaguauc

SEQ ID NO: 7260 - RNA, 38 nt, Artificial Sequence
  Description of Artificial Sequence:  Enzymatic Nucleic Acid
  misc_feature (18)..(25): n stands for any nucleotide and can be optionally absent
aucaggggcugaugaggnnnnnnnnccgaaaagaguau

SEQ ID NO: 7261 - RNA, 38 nt, Artificial Sequence
  Description of Artificial Sequence:  Enzymatic Nucleic Acid
  misc_feature (18)..(25): n stands for any nucleotide and can be optionally absent
ucccaugucugaugaggnnnnnnnnccgaaauucuuug

SEQ ID NO: 7262 - RNA, 38 nt, Artificial Sequence
  Description of Artificial Sequence:  Enzymatic Nucleic Acid
  misc_feature (18)..(25): n stands for any nucleotide and can be optionally absent
gccucucccugaugaggnnnnnnnnccgaaacuguccc

SEQ ID NO: 7263 - RNA, 38 nt, Artificial Sequence
  Description of Artificial Sequence:  Enzymatic Nucleic Acid
  misc_feature (18)..(25): n stands for any nucleotide and can be optionally absent
cuauuauacugaugaggnnnnnnnnccgaaagccucuc

SEQ ID NO: 7264 - RNA, 38 nt, Artificial Sequence
  Description of Artificial Sequence:  Enzymatic Nucleic Acid
  misc_feature (18)..(25): n stands for any nucleotide and can be optionally absent
gcuauuaucugaugaggnnnnnnnnccgaaaagccucu

SEQ ID NO: 7265 - RNA, 38 nt, Artificial Sequence
  Description of Artificial Sequence:  Enzymatic Nucleic Acid
  misc_feature (18)..(25): n stands for any nucleotide and can be optionally absent
ugcuauuacugaugaggnnnnnnnnccgaaaaagccuc

SEQ ID NO: 7266 - RNA, 38 nt, Artificial Sequence
  Description of Artificial Sequence:  Enzymatic Nucleic Acid
  misc_feature (18)..(25): n stands for any nucleotide and can be optionally absent
uuugcuaucugaugaggnnnnnnnnccgaaauaaagcc

SEQ ID NO: 7267 - RNA, 38 nt, Artificial Sequence
  Description of Artificial Sequence:  Enzymatic Nucleic Acid
  misc_feature (18)..(25): n stands for any nucleotide and can be optionally absent
gcauuugccugaugaggnnnnnnnnccgaaauuauaaa

SEQ ID NO: 7268 - RNA, 38 nt, Artificial Sequence
  Description of Artificial Sequence:  Enzymatic Nucleic Acid
  misc_feature (18)..(25): n stands for any nucleotide and can be optionally absent
ucucuuugcugaugaggnnnnnnnnccgaaacguugca

SEQ ID NO: 7269 - RNA, 38 nt, Artificial Sequence
  Description of Artificial Sequence:  Enzymatic Nucleic Acid
  misc_feature (18)..(25): n stands for any nucleotide and can be optionally absent
agcagucccugaugaggnnnnnnnnccgaaaucucuuu

SEQ ID NO: 7270 - RNA, 38 nt, Artificial Sequence
  Description of Artificial Sequence:  Enzymatic Nucleic Acid
  misc_feature (18)..(25): n stands for any nucleotide and can be optionally absent
ugcccguucugaugaggnnnnnnnnccgaaacgguggc

SEQ ID NO: 7271 - RNA, 38 nt, Artificial Sequence
  Description of Artificial Sequence:  Enzymatic Nucleic Acid
  misc_feature (18)..(25): n stands for any nucleotide and can be optionally absent
uugucuggcugaugaggnnnnnnnnccgaaacaggugc

SEQ ID NO: 7272 - RNA, 38 nt, Artificial Sequence
  Description of Artificial Sequence:  Enzymatic Nucleic Acid
  misc_feature (18)..(25): n stands for any nucleotide and can be optionally absent
gggucagacugaugaggnnnnnnnnccgaaaguuuguc

SEQ ID NO: 7273 - RNA, 38 nt, Artificial Sequence
  Description of Artificial Sequence:  Enzymatic Nucleic Acid
  misc_feature (18)..(25): n stands for any nucleotide and can be optionally absent
augggucacugaugaggnnnnnnnnccgaaauaguuug

SEQ ID NO: 7274 - RNA, 38 nt, Artificial Sequence
  Description of Artificial Sequence:  Enzymatic Nucleic Acid
  misc_feature (18)..(25): n stands for any nucleotide and can be optionally absent
ggucugcccugaugaggnnnnnnnnccgaaauggguca

SEQ ID NO: 7275 - RNA, 38 nt, Artificial Sequence
  Description of Artificial Sequence:  Enzymatic Nucleic Acid
  misc_feature (18)..(25): n stands for any nucleotide and can be optionally absent
uaggauugcugaugaggnnnnnnnnccgaaauuggucu

SEQ ID NO: 7276 - RNA, 38 nt, Artificial Sequence
  Description of Artificial Sequence:  Enzymatic Nucleic Acid
  misc_feature (18)..(25): n stands for any nucleotide and can be optionally absent
acaucuagcugaugaggnnnnnnnnccgaaauuguauu

SEQ ID NO: 7277 - RNA, 38 nt, Artificial Sequence
  Description of Artificial Sequence:  Enzymatic Nucleic Acid
  misc_feature (18)..(25): n stands for any nucleotide and can be optionally absent
uggacauccugaugaggnnnnnnnnccgaaaggauugu

SEQ ID NO: 7278 - RNA, 38 nt, Artificial Sequence
  Description of Artificial Sequence:  Enzymatic Nucleic Acid
  misc_feature (18)..(25): n stands for any nucleotide and can be optionally absent
cguauuugcugaugaggnnnnnnnnccgaaacaucuag

SEQ ID NO: 7279 - RNA, 38 nt, Artificial Sequence
  Description of Artificial Sequence:  Enzymatic Nucleic Acid
  misc_feature (18)..(25): n stands for any nucleotide and can be optionally absent
ggcgggcgcugaugaggnnnnnnnnccgaaauuuggac

SEQ ID NO: 7280 - RNA, 38 nt, Artificial Sequence
  Description of Artificial Sequence:  Enzymatic Nucleic Acid
  misc_feature (18)..(25): n stands for any nucleotide and can be optionally absent
ugcccgugcugaugaggnnnnnnnnccgaaagcagucu

SEQ ID NO: 7281 - RNA, 38 nt, Artificial Sequence
  Description of Artificial Sequence:  Enzymatic Nucleic Acid
  misc_feature (18)..(25): n stands for any nucleotide and can be optionally absent
gaggacaacugaugaggnnnnnnnnccgaaagucugcc

SEQ ID NO: 7282 - RNA, 38 nt, Artificial Sequence
  Description of Artificial Sequence:  Enzymatic Nucleic Acid
  misc_feature (18)..(25): n stands for any nucleotide and can be optionally absent
uugaggaccugaugaggnnnnnnnnccgaaagagucug

SEQ ID NO: 7283 - RNA, 38 nt, Artificial Sequence
  Description of Artificial Sequence:  Enzymatic Nucleic Acid
  misc_feature (18)..(25): n stands for any nucleotide and can be optionally absent
caguugagcugaugaggnnnnnnnnccgaaacaagagu

SEQ ID NO: 7284 - RNA, 38 nt, Artificial Sequence
  Description of Artificial Sequence:  Enzymatic Nucleic Acid
  misc_feature (18)..(25): n stands for any nucleotide and can be optionally absent
gugcaguucugaugaggnnnnnnnnccgaaaggacaag

SEQ ID NO: 7285 - RNA, 38 nt, Artificial Sequence
  Description of Artificial Sequence:  Enzymatic Nucleic Acid
  misc_feature (18)..(25): n stands for any nucleotide and can be optionally absent
cucguauucugaugaggnnnnnnnnccgaaagcuccgu

SEQ ID NO: 7286 - RNA, 38 nt, Artificial Sequence
  Description of Artificial Sequence:  Enzymatic Nucleic Acid
  misc_feature (18)..(25): n stands for any nucleotide and can be optionally absent
cacccucgcugaugaggnnnnnnnnccgaaauugagcu

SEQ ID NO: 7287 - RNA, 38 nt, Artificial Sequence
  Description of Artificial Sequence:  Enzymatic Nucleic Acid
  misc_feature (18)..(25): n stands for any nucleotide and can be optionally absent
accagggucugaugaggnnnnnnnnccgaaauuccagc

SEQ ID NO: 7288 - RNA, 38 nt, Artificial Sequence
  Description of Artificial Sequence:  Enzymatic Nucleic Acid
  misc_feature (18)..(25): n stands for any nucleotide and can be optionally absent
uaccagggcugaugaggnnnnnnnnccgaaaauuccag

SEQ ID NO: 7289 - RNA, 38 nt, Artificial Sequence
  Description of Artificial Sequence:  Enzymatic Nucleic Acid
  misc_feature (18)..(25): n stands for any nucleotide and can be optionally absent
aguugcuucugaugaggnnnnnnnnccgaaaccagggu

SEQ ID NO: 7290 - RNA, 38 nt, Artificial Sequence
  Description of Artificial Sequence:  Enzymatic Nucleic Acid
  misc_feature (18)..(25): n stands for any nucleotide and can be optionally absent
ugcucucucugaugaggnnnnnnnnccgaaaguugcuu

SEQ ID NO: 7291 - RNA, 38 nt, Artificial Sequence
  Description of Artificial Sequence:  Enzymatic Nucleic Acid
  misc_feature (18)..(25): n stands for any nucleotide and can be optionally absent
gccuuauacugaugaggnnnnnnnnccgaaaugcucuc

SEQ ID NO: 7292 - RNA, 38 nt, Artificial Sequence
  Description of Artificial Sequence:  Enzymatic Nucleic Acid
  misc_feature (18)..(25): n stands for any nucleotide and can be optionally absent
cugccuuacugaugaggnnnnnnnnccgaaagaugcuc

SEQ ID NO: 7293 - RNA, 38 nt, Artificial Sequence
  Description of Artificial Sequence:  Enzymatic Nucleic Acid
  misc_feature (18)..(25): n stands for any nucleotide and can be optionally absent
cgcugccucugaugaggnnnnnnnnccgaaauagaugc

SEQ ID NO: 7294 - RNA, 38 nt, Artificial Sequence
  Description of Artificial Sequence:  Enzymatic Nucleic Acid
  misc_feature (18)..(25): n stands for any nucleotide and can be optionally absent
cuccgguccugaugaggnnnnnnnnccgaaauccgcug

SEQ ID NO: 7295 - RNA, 38 nt, Artificial Sequence
  Description of Artificial Sequence:  Enzymatic Nucleic Acid
  misc_feature (18)..(25): n stands for any nucleotide and can be optionally absent
guugugggcugaugaggnnnnnnnnccgaaauggcucc

SEQ ID NO: 7296 - RNA, 38 nt, Artificial Sequence
  Description of Artificial Sequence:  Enzymatic Nucleic Acid
  misc_feature (18)..(25): n stands for any nucleotide and can be optionally absent
uguuguggcugaugaggnnnnnnnnccgaaaauggcuc

SEQ ID NO: 7297 - RNA, 38 nt, Artificial Sequence
  Description of Artificial Sequence:  Enzymatic Nucleic Acid
  misc_feature (18)..(25): n stands for any nucleotide and can be optionally absent
cacuguggcugaugaggnnnnnnnnccgaaacacauug

SEQ ID NO: 7298 - RNA, 38 nt, Artificial Sequence
  Description of Artificial Sequence:  Enzymatic Nucleic Acid
  misc_feature (18)..(25): n stands for any nucleotide and can be optionally absent
acacugugcugaugaggnnnnnnnnccgaaaacacauu

SEQ ID NO: 7299 - RNA, 38 nt, Artificial Sequence
  Description of Artificial Sequence:  Enzymatic Nucleic Acid
  misc_feature (18)..(25): n stands for any nucleotide and can be optionally absent
aucuuaagcugaugaggnnnnnnnnccgaaacacugug

SEQ ID NO: 7300 - RNA, 38 nt, Artificial Sequence
  Description of Artificial Sequence:  Enzymatic Nucleic Acid
  misc_feature (18)..(25): n stands for any nucleotide and can be optionally absent
gaucuuaacugaugaggnnnnnnnnccgaaaacacugu

SEQ ID NO: 7301 - RNA, 38 nt, Artificial Sequence
  Description of Artificial Sequence:  Enzymatic Nucleic Acid
  misc_feature (18)..(25): n stands for any nucleotide and can be optionally absent
uugaucuucugaugaggnnnnnnnnccgaaagaacacu

SEQ ID NO: 7302 - RNA, 38 nt, Artificial Sequence
  Description of Artificial Sequence:  Enzymatic Nucleic Acid
  misc_feature (18)..(25): n stands for any nucleotide and can be optionally absent
guugaucucugaugaggnnnnnnnnccgaaaagaacac

SEQ ID NO: 7303 - RNA, 38 nt, Artificial Sequence
  Description of Artificial Sequence:  Enzymatic Nucleic Acid
  misc_feature (18)..(25): n stands for any nucleotide and can be optionally absent
acauuguucugaugaggnnnnnnnnccgaaaucuuaag

SEQ ID NO: 7304 - RNA, 38 nt, Artificial Sequence
  Description of Artificial Sequence:  Enzymatic Nucleic Acid
  misc_feature (18)..(25): n stands for any nucleotide and can be optionally absent
cagguguacugaugaggnnnnnnnnccgaaagccccuu

SEQ ID NO: 7305 - RNA, 38 nt, Artificial Sequence
  Description of Artificial Sequence:  Enzymatic Nucleic Acid
  misc_feature (18)..(25): n stands for any nucleotide and can be optionally absent
gacaggugcugaugaggnnnnnnnnccgaaagagcccc

SEQ ID NO: 7306 - RNA, 38 nt, Artificial Sequence
  Description of Artificial Sequence:  Enzymatic Nucleic Acid
  misc_feature (18)..(25): n stands for any nucleotide and can be optionally absent
cuucacgccugaugaggnnnnnnnnccgaaacaggugu

SEQ ID NO: 7307 - RNA, 38 nt, Artificial Sequence
  Description of Artificial Sequence:  Enzymatic Nucleic Acid
  misc_feature (18)..(25): n stands for any nucleotide and can be optionally absent
ggaacgagcugaugaggnnnnnnnnccgaaacccacuc

SEQ ID NO: 7308 - RNA, 38 nt, Artificial Sequence
  Description of Artificial Sequence:  Enzymatic Nucleic Acid
  misc_feature (18)..(25): n stands for any nucleotide and can be optionally absent
acuggaaccugaugaggnnnnnnnnccgaaaggaccca

SEQ ID NO: 7309 - RNA, 38 nt, Artificial Sequence
  Description of Artificial Sequence:  Enzymatic Nucleic Acid
  misc_feature (18)..(25): n stands for any nucleotide and can be optionally absent
aagacuggcugaugaggnnnnnnnnccgaaacgaggac

SEQ ID NO: 7310 - RNA, 38 nt, Artificial Sequence
  Description of Artificial Sequence:  Enzymatic Nucleic Acid
  misc_feature (18)..(25): n stands for any nucleotide and can be optionally absent
aaagacugcugaugaggnnnnnnnnccgaaaacgagga

SEQ ID NO: 7311 - RNA, 38 nt, Artificial Sequence
  Description of Artificial Sequence:  Enzymatic Nucleic Acid
  misc_feature (18)..(25): n stands for any nucleotide and can be optionally absent
uguugaaacugaugaggnnnnnnnnccgaaacuggaac

SEQ ID NO: 7312 - RNA, 38 nt, Artificial Sequence
  Description of Artificial Sequence:  Enzymatic Nucleic Acid
  misc_feature (18)..(25): n stands for any nucleotide and can be optionally absent
gguguugacugaugaggnnnnnnnnccgaaagacugga

SEQ ID NO: 7313 - RNA, 38 nt, Artificial Sequence
  Description of Artificial Sequence:  Enzymatic Nucleic Acid
  misc_feature (18)..(25): n stands for any nucleotide and can be optionally absent
agguguugcugaugaggnnnnnnnnccgaaaagacugg

SEQ ID NO: 7314 - RNA, 38 nt, Artificial Sequence
  Description of Artificial Sequence:  Enzymatic Nucleic Acid
  misc_feature (18)..(25): n stands for any nucleotide and can be optionally absent
gagguguucugaugaggnnnnnnnnccgaaaaagacug

SEQ ID NO: 7315 - RNA, 38 nt, Artificial Sequence
  Description of Artificial Sequence:  Enzymatic Nucleic Acid
  misc_feature (18)..(25): n stands for any nucleotide and can be optionally absent
caugcacgcugaugaggnnnnnnnnccgaaagguguug

SEQ ID NO: 7316 - RNA, 38 nt, Artificial Sequence
  Description of Artificial Sequence:  Enzymatic Nucleic Acid
  misc_feature (18)..(25): n stands for any nucleotide and can be optionally absent
cuuuuucacugaugaggnnnnnnnnccgaaacacaugc

SEQ ID NO: 7317 - RNA, 38 nt, Artificial Sequence
  Description of Artificial Sequence:  Enzymatic Nucleic Acid
  misc_feature (18)..(25): n stands for any nucleotide and can be optionally absent
cacugaugcugaugaggnnnnnnnnccgaaauccuuuu

SEQ ID NO: 7318 - RNA, 38 nt, Artificial Sequence
  Description of Artificial Sequence:  Enzymatic Nucleic Acid
  misc_feature (18)..(25): n stands for any nucleotide and can be optionally absent
acacugaucugaugaggnnnnnnnnccgaaaauccuuu

SEQ ID NO: 7319 - RNA, 38 nt, Artificial Sequence
  Description of Artificial Sequence:  Enzymatic Nucleic Acid
  misc_feature (18)..(25): n stands for any nucleotide and can be optionally absent
uucacacucugaugaggnnnnnnnnccgaaaugaaucc

SEQ ID NO: 7320 - RNA, 38 nt, Artificial Sequence
  Description of Artificial Sequence:  Enzymatic Nucleic Acid
  misc_feature (18)..(25): n stands for any nucleotide and can be optionally absent
cugcuucccugaugaggnnnnnnnnccgaaauguuuca

SEQ ID NO: 7321 - RNA, 38 nt, Artificial Sequence
  Description of Artificial Sequence:  Enzymatic Nucleic Acid
  misc_feature (18)..(25): n stands for any nucleotide and can be optionally absent
gccgauagcugaugaggnnnnnnnnccgaaaccgucuu

SEQ ID NO: 7322 - RNA, 38 nt, Artificial Sequence
  Description of Artificial Sequence:  Enzymatic Nucleic Acid
  misc_feature (18)..(25): n stands for any nucleotide and can be optionally absent
acagccgacugaugaggnnnnnnnnccgaaaggaccgu

SEQ ID NO: 7323 - RNA, 38 nt, Artificial Sequence
  Description of Artificial Sequence:  Enzymatic Nucleic Acid
  misc_feature (18)..(25): n stands for any nucleotide and can be optionally absent
ggacagcccugaugaggnnnnnnnnccgaaauaggacc

SEQ ID NO: 7324 - RNA, 38 nt, Artificial Sequence
  Description of Artificial Sequence:  Enzymatic Nucleic Acid
  misc_feature (18)..(25): n stands for any nucleotide and can be optionally absent
cuuucaugcugaugaggnnnnnnnnccgaaacagccga

SEQ ID NO: 7325 - RNA, 38 nt, Artificial Sequence
  Description of Artificial Sequence:  Enzymatic Nucleic Acid
  misc_feature (18)..(25): n stands for any nucleotide and can be optionally absent
gggaggggcugaugaggnnnnnnnnccgaaaggccuuc

SEQ ID NO: 7326 - RNA, 38 nt, Artificial Sequence
  Description of Artificial Sequence:  Enzymatic Nucleic Acid
  misc_feature (18)..(25): n stands for any nucleotide and can be optionally absent
ggggagggcugaugaggnnnnnnnnccgaaaaggccuu

SEQ ID NO: 7327 - RNA, 38 nt, Artificial Sequence
  Description of Artificial Sequence:  Enzymatic Nucleic Acid
  misc_feature (18)..(25): n stands for any nucleotide and can be optionally absent
uuucugggcugaugaggnnnnnnnnccgaaaggggaag

SEQ ID NO: 7328 - RNA, 38 nt, Artificial Sequence
  Description of Artificial Sequence:  Enzymatic Nucleic Acid
  misc_feature (18)..(25): n stands for any nucleotide and can be optionally absent
aaccauaccugaugaggnnnnnnnnccgaaauuucugg

SEQ ID NO: 7329 - RNA, 38 nt, Artificial Sequence
  Description of Artificial Sequence:  Enzymatic Nucleic Acid
  misc_feature (18)..(25): n stands for any nucleotide and can be optionally absent
uuuaaccacugaugaggnnnnnnnnccgaaacgauuuc

SEQ ID NO: 7330 - RNA, 38 nt, Artificial Sequence
  Description of Artificial Sequence:  Enzymatic Nucleic Acid
  misc_feature (18)..(25): n stands for any nucleotide and can be optionally absent
caucuuuucugaugaggnnnnnnnnccgaaaccauacg

SEQ ID NO: 7331 - RNA, 38 nt, Artificial Sequence
  Description of Artificial Sequence:  Enzymatic Nucleic Acid
  misc_feature (18)..(25): n stands for any nucleotide and can be optionally absent
uugcaggccugaugaggnnnnnnnnccgaaagccaucu

SEQ ID NO: 7332 - RNA, 38 nt, Artificial Sequence
  Description of Artificial Sequence:  Enzymatic Nucleic Acid
  misc_feature (18)..(25): n stands for any nucleotide and can be optionally absent
cagacuuccugaugaggnnnnnnnnccgaaauguugca

SEQ ID NO: 7333 - RNA, 38 nt, Artificial Sequence
  Description of Artificial Sequence:  Enzymatic Nucleic Acid
  misc_feature (18)..(25): n stands for any nucleotide and can be optionally absent
agcgagcacugaugaggnnnnnnnnccgaaacuucaau

SEQ ID NO: 7334 - RNA, 38 nt, Artificial Sequence
  Description of Artificial Sequence:  Enzymatic Nucleic Acid
  misc_feature (18)..(25): n stands for any nucleotide and can be optionally absent
caaauagccugaugaggnnnnnnnnccgaaagcagacu

SEQ ID NO: 7335 - RNA, 38 nt, Artificial Sequence
  Description of Artificial Sequence:  Enzymatic Nucleic Acid
  misc_feature (18)..(25): n stands for any nucleotide and can be optionally absent
guaccaaacugaugaggnnnnnnnnccgaaagcgagca

SEQ ID NO: 7336 - RNA, 38 nt, Artificial Sequence
  Description of Artificial Sequence:  Enzymatic Nucleic Acid
  misc_feature (18)..(25): n stands for any nucleotide and can be optionally absent
auguaccacugaugaggnnnnnnnnccgaaauagcgag

SEQ ID NO: 7337 - RNA, 38 nt, Artificial Sequence
  Description of Artificial Sequence:  Enzymatic Nucleic Acid
  misc_feature (18)..(25): n stands for any nucleotide and can be optionally absent
cauguacccugaugaggnnnnnnnnccgaaaauagcga

SEQ ID NO: 7338 - RNA, 38 nt, Artificial Sequence
  Description of Artificial Sequence:  Enzymatic Nucleic Acid
  misc_feature (18)..(25): n stands for any nucleotide and can be optionally absent
uagccaugcugaugaggnnnnnnnnccgaaaccaaaua

SEQ ID NO: 7339 - RNA, 38 nt, Artificial Sequence
  Description of Artificial Sequence:  Enzymatic Nucleic Acid
  misc_feature (18)..(25): n stands for any nucleotide and can be optionally absent
uuaaugagcugaugaggnnnnnnnnccgaaagccaugu

SEQ ID NO: 7340 - RNA, 38 nt, Artificial Sequence
  Description of Artificial Sequence:  Enzymatic Nucleic Acid
  misc_feature (18)..(25): n stands for any nucleotide and can be optionally absent
uaauuaaucugaugaggnnnnnnnnccgaaaguagcca

SEQ ID NO: 7341 - RNA, 38 nt, Artificial Sequence
  Description of Artificial Sequence:  Enzymatic Nucleic Acid
  misc_feature (18)..(25): n stands for any nucleotide and can be optionally absent
ugauaauucugaugaggnnnnnnnnccgaaaugaguag

SEQ ID NO: 7342 - RNA, 38 nt, Artificial Sequence
  Description of Artificial Sequence:  Enzymatic Nucleic Acid
  misc_feature (18)..(25): n stands for any nucleotide and can be optionally absent
uugauaaucugaugaggnnnnnnnnccgaaaaugagua

SEQ ID NO: 7343 - RNA, 38 nt, Artificial Sequence
  Description of Artificial Sequence:  Enzymatic Nucleic Acid
  misc_feature (18)..(25): n stands for any nucleotide and can be optionally absent
ucuuugaucugaugaggnnnnnnnnccgaaauuaauga

SEQ ID NO: 7344 - RNA, 38 nt, Artificial Sequence
  Description of Artificial Sequence:  Enzymatic Nucleic Acid
  misc_feature (18)..(25): n stands for any nucleotide and can be optionally absent
aucuuugacugaugaggnnnnnnnnccgaaaauuaaug

SEQ ID NO: 7345 - RNA, 38 nt, Artificial Sequence
  Description of Artificial Sequence:  Enzymatic Nucleic Acid
  misc_feature (18)..(25): n stands for any nucleotide and can be optionally absent
acaucuuucugaugaggnnnnnnnnccgaaauaauuaa

SEQ ID NO: 7346 - RNA, 38 nt, Artificial Sequence
  Description of Artificial Sequence:  Enzymatic Nucleic Acid
  misc_feature (18)..(25): n stands for any nucleotide and can be optionally absent
agaucguacugaugaggnnnnnnnnccgaaaguccccu

SEQ ID NO: 7347 - RNA, 38 nt, Artificial Sequence
  Description of Artificial Sequence:  Enzymatic Nucleic Acid
  misc_feature (18)..(25): n stands for any nucleotide and can be optionally absent
caagaucgcugaugaggnnnnnnnnccgaaauaguccc

SEQ ID NO: 7348 - RNA, 38 nt, Artificial Sequence
  Description of Artificial Sequence:  Enzymatic Nucleic Acid
  misc_feature (18)..(25): n stands for any nucleotide and can be optionally absent
cccagcaacugaugaggnnnnnnnnccgaaaucguaua

SEQ ID NO: 7349 - RNA, 38 nt, Artificial Sequence
  Description of Artificial Sequence:  Enzymatic Nucleic Acid
  misc_feature (18)..(25): n stands for any nucleotide and can be optionally absent
ugcccagccugaugaggnnnnnnnnccgaaagaucgua

SEQ ID NO: 7350 - RNA, 38 nt, Artificial Sequence
  Description of Artificial Sequence:  Enzymatic Nucleic Acid
  misc_feature (18)..(25): n stands for any nucleotide and can be optionally absent
gacugcuucugaugaggnnnnnnnnccgaaaugcccag

SEQ ID NO: 7351 - RNA, 38 nt, Artificial Sequence
  Description of Artificial Sequence:  Enzymatic Nucleic Acid
  misc_feature (18)..(25): n stands for any nucleotide and can be optionally absent
auagccuucugaugaggnnnnnnnnccgaaacugcuuu

SEQ ID NO: 7352 - RNA, 38 nt, Artificial Sequence
  Description of Artificial Sequence:  Enzymatic Nucleic Acid
  misc_feature (18)..(25): n stands for any nucleotide and can be optionally absent
uuuuuaaacugaugaggnnnnnnnnccgaaagccuuga

SEQ ID NO: 7353 - RNA, 38 nt, Artificial Sequence
  Description of Artificial Sequence:  Enzymatic Nucleic Acid
  misc_feature (18)..(25): n stands for any nucleotide and can be optionally absent
gguuuuuacugaugaggnnnnnnnnccgaaauagccuu

SEQ ID NO: 7354 - RNA, 38 nt, Artificial Sequence
  Description of Artificial Sequence:  Enzymatic Nucleic Acid
  misc_feature (18)..(25): n stands for any nucleotide and can be optionally absent
agguuuuucugaugaggnnnnnnnnccgaaaauagccu

SEQ ID NO: 7355 - RNA, 38 nt, Artificial Sequence
  Description of Artificial Sequence:  Enzymatic Nucleic Acid
  misc_feature (18)..(25): n stands for any nucleotide and can be optionally absent
gagguuuucugaugaggnnnnnnnnccgaaaaauagcc

SEQ ID NO: 7356 - RNA, 38 nt, Artificial Sequence
  Description of Artificial Sequence:  Enzymatic Nucleic Acid
  misc_feature (18)..(25): n stands for any nucleotide and can be optionally absent
uacaaugacugaugaggnnnnnnnnccgaaaguggcag

SEQ ID NO: 7357 - RNA, 38 nt, Artificial Sequence
  Description of Artificial Sequence:  Enzymatic Nucleic Acid
  misc_feature (18)..(25): n stands for any nucleotide and can be optionally absent
uuuacaaucugaugaggnnnnnnnnccgaaagaguggc

SEQ ID NO: 7358 - RNA, 38 nt, Artificial Sequence
  Description of Artificial Sequence:  Enzymatic Nucleic Acid
  misc_feature (18)..(25): n stands for any nucleotide and can be optionally absent
acguuuaccugaugaggnnnnnnnnccgaaaugagagu

SEQ ID NO: 7359 - RNA, 38 nt, Artificial Sequence
  Description of Artificial Sequence:  Enzymatic Nucleic Acid
  misc_feature (18)..(25): n stands for any nucleotide and can be optionally absent
uucacguucugaugaggnnnnnnnnccgaaacaaugag

SEQ ID NO: 7360 - RNA, 38 nt, Artificial Sequence
  Description of Artificial Sequence:  Enzymatic Nucleic Acid
  misc_feature (18)..(25): n stands for any nucleotide and can be optionally absent
guagaucucugaugaggnnnnnnnnccgaaagguuuca

SEQ ID NO: 7361 - RNA, 38 nt, Artificial Sequence
  Description of Artificial Sequence:  Enzymatic Nucleic Acid
  misc_feature (18)..(25): n stands for any nucleotide and can be optionally absent
uuuucguacugaugaggnnnnnnnnccgaaaucugagg

SEQ ID NO: 7362 - RNA, 38 nt, Artificial Sequence
  Description of Artificial Sequence:  Enzymatic Nucleic Acid
  misc_feature (18)..(25): n stands for any nucleotide and can be optionally absent
acuuuucgcugaugaggnnnnnnnnccgaaagaucuga

SEQ ID NO: 7363 - RNA, 38 nt, Artificial Sequence
  Description of Artificial Sequence:  Enzymatic Nucleic Acid
  misc_feature (18)..(25): n stands for any nucleotide and can be optionally absent
aggacacgcugaugaggnnnnnnnnccgaaacuuuucg

SEQ ID NO: 7364 - RNA, 38 nt, Artificial Sequence
  Description of Artificial Sequence:  Enzymatic Nucleic Acid
  misc_feature (18)..(25): n stands for any nucleotide and can be optionally absent
gaagcgagcugaugaggnnnnnnnnccgaaacacggac

SEQ ID NO: 7365 - RNA, 38 nt, Artificial Sequence
  Description of Artificial Sequence:  Enzymatic Nucleic Acid
  misc_feature (18)..(25): n stands for any nucleotide and can be optionally absent
uuggaagccugaugaggnnnnnnnnccgaaaggacacg

SEQ ID NO: 7366 - RNA, 38 nt, Artificial Sequence
  Description of Artificial Sequence:  Enzymatic Nucleic Acid
  misc_feature (18)..(25): n stands for any nucleotide and can be optionally absent
gggcuuggcugaugaggnnnnnnnnccgaaagcgagga

SEQ ID NO: 7367 - RNA, 38 nt, Artificial Sequence
  Description of Artificial Sequence:  Enzymatic Nucleic Acid
  misc_feature (18)..(25): n stands for any nucleotide and can be optionally absent
ugggcuugcugaugaggnnnnnnnnccgaaaagcgagg

SEQ ID NO: 7368 - RNA, 38 nt, Artificial Sequence
  Description of Artificial Sequence:  Enzymatic Nucleic Acid
  misc_feature (18)..(25): n stands for any nucleotide and can be optionally absent
cggauagacugaugaggnnnnnnnnccgaaaggugggc

SEQ ID NO: 7369 - RNA, 38 nt, Artificial Sequence
  Description of Artificial Sequence:  Enzymatic Nucleic Acid
  misc_feature (18)..(25): n stands for any nucleotide and can be optionally absent
agcggauacugaugaggnnnnnnnnccgaaagaggugg

SEQ ID NO: 7370 - RNA, 38 nt, Artificial Sequence
  Description of Artificial Sequence:  Enzymatic Nucleic Acid
  misc_feature (18)..(25): n stands for any nucleotide and can be optionally absent
ccagcggacugaugaggnnnnnnnnccgaaagagaggu

SEQ ID NO: 7371 - RNA, 38 nt, Artificial Sequence
  Description of Artificial Sequence:  Enzymatic Nucleic Acid
  misc_feature (18)..(25): n stands for any nucleotide and can be optionally absent
gcccagcgcugaugaggnnnnnnnnccgaaauagagag

SEQ ID NO: 7372 - RNA, 38 nt, Artificial Sequence
  Description of Artificial Sequence:  Enzymatic Nucleic Acid
  misc_feature (18)..(25): n stands for any nucleotide and can be optionally absent
caagugagcugaugaggnnnnnnnnccgaaacuugucu

SEQ ID NO: 7373 - RNA, 38 nt, Artificial Sequence
  Description of Artificial Sequence:  Enzymatic Nucleic Acid
  misc_feature (18)..(25): n stands for any nucleotide and can be optionally absent
gugcaagucugaugaggnnnnnnnnccgaaaggacuug

SEQ ID NO: 7374 - RNA, 38 nt, Artificial Sequence
  Description of Artificial Sequence:  Enzymatic Nucleic Acid
  misc_feature (18)..(25): n stands for any nucleotide and can be optionally absent
cacggugccugaugaggnnnnnnnnccgaaagugagga

SEQ ID NO: 7375 - RNA, 38 nt, Artificial Sequence
  Description of Artificial Sequence:  Enzymatic Nucleic Acid
  misc_feature (18)..(25): n stands for any nucleotide and can be optionally absent
ggaugccacugaugaggnnnnnnnnccgaaacacggug

SEQ ID NO: 7376 - RNA, 38 nt, Artificial Sequence
  Description of Artificial Sequence:  Enzymatic Nucleic Acid
  misc_feature (18)..(25): n stands for any nucleotide and can be optionally absent
ggccgaggcugaugaggnnnnnnnnccgaaaugccaua

SEQ ID NO: 7377 - RNA, 38 nt, Artificial Sequence
  Description of Artificial Sequence:  Enzymatic Nucleic Acid
  misc_feature (18)..(25): n stands for any nucleotide and can be optionally absent
uguuggcccugaugaggnnnnnnnnccgaaagggaugc

SEQ ID NO: 7378 - RNA, 38 nt, Artificial Sequence
  Description of Artificial Sequence:  Enzymatic Nucleic Acid
  misc_feature (18)..(25): n stands for any nucleotide and can be optionally absent
agccacgucugaugaggnnnnnnnnccgaaauuguugg

SEQ ID NO: 7379 - RNA, 38 nt, Artificial Sequence
  Description of Artificial Sequence:  Enzymatic Nucleic Acid
  misc_feature (18)..(25): n stands for any nucleotide and can be optionally absent
gggugccacugaugaggnnnnnnnnccgaaagccacgu

SEQ ID NO: 7380 - RNA, 38 nt, Artificial Sequence
  Description of Artificial Sequence:  Enzymatic Nucleic Acid
  misc_feature (18)..(25): n stands for any nucleotide and can be optionally absent
auuguggucugaugaggnnnnnnnnccgaaacaggggu

SEQ ID NO: 7381 - RNA, 38 nt, Artificial Sequence
  Description of Artificial Sequence:  Enzymatic Nucleic Acid
  misc_feature (18)..(25): n stands for any nucleotide and can be optionally absent
uuuggagucugaugaggnnnnnnnnccgaaauuguggu

SEQ ID NO: 7382 - RNA, 38 nt, Artificial Sequence
  Description of Artificial Sequence:  Enzymatic Nucleic Acid
  misc_feature (18)..(25): n stands for any nucleotide and can be optionally absent
uuucuuugcugaugaggnnnnnnnnccgaaagugauug

SEQ ID NO: 7383 - RNA, 38 nt, Artificial Sequence
  Description of Artificial Sequence:  Enzymatic Nucleic Acid
  misc_feature (18)..(25): n stands for any nucleotide and can be optionally absent
agaagucacugaugaggnnnnnnnnccgaaaccuuucu

SEQ ID NO: 7384 - RNA, 38 nt, Artificial Sequence
  Description of Artificial Sequence:  Enzymatic Nucleic Acid
  misc_feature (18)..(25): n stands for any nucleotide and can be optionally absent
cagugcagcugaugaggnnnnnnnnccgaaagucauac

SEQ ID NO: 7385 - RNA, 38 nt, Artificial Sequence
  Description of Artificial Sequence:  Enzymatic Nucleic Acid
  misc_feature (18)..(25): n stands for any nucleotide and can be optionally absent
ucagugcacugaugaggnnnnnnnnccgaaaagucaua

SEQ ID NO: 7386 - RNA, 38 nt, Artificial Sequence
  Description of Artificial Sequence:  Enzymatic Nucleic Acid
  misc_feature (18)..(25): n stands for any nucleotide and can be optionally absent
ggauaaagcugaugaggnnnnnnnnccgaaauucuuca

SEQ ID NO: 7387 - RNA, 38 nt, Artificial Sequence
  Description of Artificial Sequence:  Enzymatic Nucleic Acid
  misc_feature (18)..(25): n stands for any nucleotide and can be optionally absent
ccaggauacugaugaggnnnnnnnnccgaaaggauucu

SEQ ID NO: 7388 - RNA, 38 nt, Artificial Sequence
  Description of Artificial Sequence:  Enzymatic Nucleic Acid
  misc_feature (18)..(25): n stands for any nucleotide and can be optionally absent
uccaggaucugaugaggnnnnnnnnccgaaaaggauuc

SEQ ID NO: 7389 - RNA, 38 nt, Artificial Sequence
  Description of Artificial Sequence:  Enzymatic Nucleic Acid
  misc_feature (18)..(25): n stands for any nucleotide and can be optionally absent
auccaggacugaugaggnnnnnnnnccgaaaaaggauu

SEQ ID NO: 7390 - RNA, 38 nt, Artificial Sequence
  Description of Artificial Sequence:  Enzymatic Nucleic Acid
  misc_feature (18)..(25): n stands for any nucleotide and can be optionally absent
ggauccagcugaugaggnnnnnnnnccgaaauaaagga

SEQ ID NO: 7391 - RNA, 38 nt, Artificial Sequence
  Description of Artificial Sequence:  Enzymatic Nucleic Acid
  misc_feature (18)..(25): n stands for any nucleotide and can be optionally absent
gcugcuggcugaugaggnnnnnnnnccgaaauccagga

SEQ ID NO: 7392 - RNA, 38 nt, Artificial Sequence
  Description of Artificial Sequence:  Enzymatic Nucleic Acid
  misc_feature (18)..(25): n stands for any nucleotide and can be optionally absent
uguuuccucugaugaggnnnnnnnnccgaaaguugcug

SEQ ID NO: 7393 - RNA, 38 nt, Artificial Sequence
  Description of Artificial Sequence:  Enzymatic Nucleic Acid
  misc_feature (18)..(25): n stands for any nucleotide and can be optionally absent
cuguuucccugaugaggnnnnnnnnccgaaaaguugcu

SEQ ID NO: 7394 - RNA, 38 nt, Artificial Sequence
  Description of Artificial Sequence:  Enzymatic Nucleic Acid
  misc_feature (18)..(25): n stands for any nucleotide and can be optionally absent
cgcugagacugaugaggnnnnnnnnccgaaaugcucuc

SEQ ID NO: 7395 - RNA, 38 nt, Artificial Sequence
  Description of Artificial Sequence:  Enzymatic Nucleic Acid
  misc_feature (18)..(25): n stands for any nucleotide and can be optionally absent
ugcgcugacugaugaggnnnnnnnnccgaaagaugcuc

SEQ ID NO: 7396 - RNA, 38 nt, Artificial Sequence
  Description of Artificial Sequence:  Enzymatic Nucleic Acid
  misc_feature (18)..(25): n stands for any nucleotide and can be optionally absent
caugcgcucugaugaggnnnnnnnnccgaaagagaugc

SEQ ID NO: 7397 - RNA, 38 nt, Artificial Sequence
  Description of Artificial Sequence:  Enzymatic Nucleic Acid
  misc_feature (18)..(25): n stands for any nucleotide and can be optionally absent
ccuucuaucugaugaggnnnnnnnnccgaaaccgucau

SEQ ID NO: 7398 - RNA, 38 nt, Artificial Sequence
  Description of Artificial Sequence:  Enzymatic Nucleic Acid
  misc_feature (18)..(25): n stands for any nucleotide and can be optionally absent
guuccuuccugaugaggnnnnnnnnccgaaaugaccgu

SEQ ID NO: 7399 - RNA, 38 nt, Artificial Sequence
  Description of Artificial Sequence:  Enzymatic Nucleic Acid
  misc_feature (18)..(25): n stands for any nucleotide and can be optionally absent
aaccgucucugaugaggnnnnnnnnccgaaauuuguuc

SEQ ID NO: 7400 - RNA, 38 nt, Artificial Sequence
  Description of Artificial Sequence:  Enzymatic Nucleic Acid
  misc_feature (18)..(25): n stands for any nucleotide and can be optionally absent
aaugugcucugaugaggnnnnnnnnccgaaaccgucuu

SEQ ID NO: 7401 - RNA, 38 nt, Artificial Sequence
  Description of Artificial Sequence:  Enzymatic Nucleic Acid
  misc_feature (18)..(25): n stands for any nucleotide and can be optionally absent
caaugugccugaugaggnnnnnnnnccgaaaaccgucu

SEQ ID NO: 7402 - RNA, 38 nt, Artificial Sequence
  Description of Artificial Sequence:  Enzymatic Nucleic Acid
  misc_feature (18)..(25): n stands for any nucleotide and can be optionally absent
ccaccacccugaugaggnnnnnnnnccgaaaugugcua

SEQ ID NO: 7403 - RNA, 38 nt, Artificial Sequence
  Description of Artificial Sequence:  Enzymatic Nucleic Acid
  misc_feature (18)..(25): n stands for any nucleotide and can be optionally absent
gggucugacugaugaggnnnnnnnnccgaaagucagcc

SEQ ID NO: 7404 - RNA, 38 nt, Artificial Sequence
  Description of Artificial Sequence:  Enzymatic Nucleic Acid
  misc_feature (18)..(25): n stands for any nucleotide and can be optionally absent
aggggucucugaugaggnnnnnnnnccgaaagagucag

SEQ ID NO: 7405 - RNA, 38 nt, Artificial Sequence
  Description of Artificial Sequence:  Enzymatic Nucleic Acid
  misc_feature (18)..(25): n stands for any nucleotide and can be optionally absent
cagcuguacugaugaggnnnnnnnnccgaaauuccagg

SEQ ID NO: 7406 - RNA, 38 nt, Artificial Sequence
  Description of Artificial Sequence:  Enzymatic Nucleic Acid
  misc_feature (18)..(25): n stands for any nucleotide and can be optionally absent
ggcagcugcugaugaggnnnnnnnnccgaaagauucca

SEQ ID NO: 7407 - RNA, 38 nt, Artificial Sequence
  Description of Artificial Sequence:  Enzymatic Nucleic Acid
  misc_feature (18)..(25): n stands for any nucleotide and can be optionally absent
uuuuauugcugaugaggnnnnnnnnccgaaaggcccgg

SEQ ID NO: 7408 - RNA, 38 nt, Artificial Sequence
  Description of Artificial Sequence:  Enzymatic Nucleic Acid
  misc_feature (18)..(25): n stands for any nucleotide and can be optionally absent
auuuuauucugaugaggnnnnnnnnccgaaaaggcccg

SEQ ID NO: 7409 - RNA, 38 nt, Artificial Sequence
  Description of Artificial Sequence:  Enzymatic Nucleic Acid
  misc_feature (18)..(25): n stands for any nucleotide and can be optionally absent
cccuauuucugaugaggnnnnnnnnccgaaauugaagg

SEQ ID NO: 7410 - RNA, 38 nt, Artificial Sequence
  Description of Artificial Sequence:  Enzymatic Nucleic Acid
  misc_feature (18)..(25): n stands for any nucleotide and can be optionally absent
acaguccccugaugaggnnnnnnnnccgaaauuuuauu

SEQ ID NO: 7411 - RNA, 38 nt, Artificial Sequence
  Description of Artificial Sequence:  Enzymatic Nucleic Acid
  misc_feature (18)..(25): n stands for any nucleotide and can be optionally absent
uaaaauuucugaugaggnnnnnnnnccgaaauguuucu

SEQ ID NO: 7412 - RNA, 38 nt, Artificial Sequence
  Description of Artificial Sequence:  Enzymatic Nucleic Acid
  misc_feature (18)..(25): n stands for any nucleotide and can be optionally absent
ugacauaacugaugaggnnnnnnnnccgaaauuuuaug

SEQ ID NO: 7413 - RNA, 38 nt, Artificial Sequence
  Description of Artificial Sequence:  Enzymatic Nucleic Acid
  misc_feature (18)..(25): n stands for any nucleotide and can be optionally absent
gugacauacugaugaggnnnnnnnnccgaaaauuuuau

SEQ ID NO: 7414 - RNA, 38 nt, Artificial Sequence
  Description of Artificial Sequence:  Enzymatic Nucleic Acid
  misc_feature (18)..(25): n stands for any nucleotide and can be optionally absent
ugugacaucugaugaggnnnnnnnnccgaaaaauuuua

SEQ ID NO: 7415 - RNA, 38 nt, Artificial Sequence
  Description of Artificial Sequence:  Enzymatic Nucleic Acid
  misc_feature (18)..(25): n stands for any nucleotide and can be optionally absent
cugugacacugaugaggnnnnnnnnccgaaaaaauuuu

SEQ ID NO: 7416 - RNA, 38 nt, Artificial Sequence
  Description of Artificial Sequence:  Enzymatic Nucleic Acid
  misc_feature (18)..(25): n stands for any nucleotide and can be optionally absent
acaucugucugaugaggnnnnnnnnccgaaacauaaaa

SEQ ID NO: 7417 - RNA, 38 nt, Artificial Sequence
  Description of Artificial Sequence:  Enzymatic Nucleic Acid
  misc_feature (18)..(25): n stands for any nucleotide and can be optionally absent
aaacgugacugaugaggnnnnnnnnccgaaagccauuc

SEQ ID NO: 7418 - RNA, 38 nt, Artificial Sequence
  Description of Artificial Sequence:  Enzymatic Nucleic Acid
  misc_feature (18)..(25): n stands for any nucleotide and can be optionally absent
gaaacgugcugaugaggnnnnnnnnccgaaaagccauu

SEQ ID NO: 7419 - RNA, 38 nt, Artificial Sequence
  Description of Artificial Sequence:  Enzymatic Nucleic Acid
  misc_feature (18)..(25): n stands for any nucleotide and can be optionally absent
ggaaacgucugaugaggnnnnnnnnccgaaaaagccau

SEQ ID NO: 7420 - RNA, 38 nt, Artificial Sequence
  Description of Artificial Sequence:  Enzymatic Nucleic Acid
  misc_feature (18)..(25): n stands for any nucleotide and can be optionally absent
uccaaggacugaugaggnnnnnnnnccgaaacgugaaa

SEQ ID NO: 7421 - RNA, 38 nt, Artificial Sequence
  Description of Artificial Sequence:  Enzymatic Nucleic Acid
  misc_feature (18)..(25): n stands for any nucleotide and can be optionally absent
uuccaaggcugaugaggnnnnnnnnccgaaaacgugaa

SEQ ID NO: 7422 - RNA, 38 nt, Artificial Sequence
  Description of Artificial Sequence:  Enzymatic Nucleic Acid
  misc_feature (18)..(25): n stands for any nucleotide and can be optionally absent
uuuccaagcugaugaggnnnnnnnnccgaaaaacguga

SEQ ID NO: 7423 - RNA, 38 nt, Artificial Sequence
  Description of Artificial Sequence:  Enzymatic Nucleic Acid
  misc_feature (18)..(25): n stands for any nucleotide and can be optionally absent
ucuuuucccugaugaggnnnnnnnnccgaaaggaaacg

SEQ ID NO: 7424 - RNA, 38 nt, Artificial Sequence
  Description of Artificial Sequence:  Enzymatic Nucleic Acid
  misc_feature (18)..(25): n stands for any nucleotide and can be optionally absent
ccacacagcugaugaggnnnnnnnnccgaaacaguuuc

SEQ ID NO: 7425 - RNA, 38 nt, Artificial Sequence
  Description of Artificial Sequence:  Enzymatic Nucleic Acid
  misc_feature (18)..(25): n stands for any nucleotide and can be optionally absent
aauuuauucugaugaggnnnnnnnnccgaaaccacaca

SEQ ID NO: 7426 - RNA, 38 nt, Artificial Sequence
  Description of Artificial Sequence:  Enzymatic Nucleic Acid
  misc_feature (18)..(25): n stands for any nucleotide and can be optionally absent
caggaauucugaugaggnnnnnnnnccgaaauugacca

SEQ ID NO: 7427 - RNA, 38 nt, Artificial Sequence
  Description of Artificial Sequence:  Enzymatic Nucleic Acid
  misc_feature (18)..(25): n stands for any nucleotide and can be optionally absent
uguacaggcugaugaggnnnnnnnnccgaaauuuauug

SEQ ID NO: 7428 - RNA, 38 nt, Artificial Sequence
  Description of Artificial Sequence:  Enzymatic Nucleic Acid
  misc_feature (18)..(25): n stands for any nucleotide and can be optionally absent
cuguacagcugaugaggnnnnnnnnccgaaaauuuauu

SEQ ID NO: 7429 - RNA, 38 nt, Artificial Sequence
  Description of Artificial Sequence:  Enzymatic Nucleic Acid
  misc_feature (18)..(25): n stands for any nucleotide and can be optionally absent
ugucucugcugaugaggnnnnnnnnccgaaacaggaau

SEQ ID NO: 7430 - RNA, 38 nt, Artificial Sequence
  Description of Artificial Sequence:  Enzymatic Nucleic Acid
  misc_feature (18)..(25): n stands for any nucleotide and can be optionally absent
auccaggucugaugaggnnnnnnnnccgaaaugucucu

SEQ ID NO: 7431 - RNA, 38 nt, Artificial Sequence
  Description of Artificial Sequence:  Enzymatic Nucleic Acid
  misc_feature (18)..(25): n stands for any nucleotide and can be optionally absent
aauccaggcugaugaggnnnnnnnnccgaaaaugucuc

SEQ ID NO: 7432 - RNA, 38 nt, Artificial Sequence
  Description of Artificial Sequence:  Enzymatic Nucleic Acid
  misc_feature (18)..(25): n stands for any nucleotide and can be optionally absent
cguagcagcugaugaggnnnnnnnnccgaaauccaggu

SEQ ID NO: 7433 - RNA, 38 nt, Artificial Sequence
  Description of Artificial Sequence:  Enzymatic Nucleic Acid
  misc_feature (18)..(25): n stands for any nucleotide and can be optionally absent
ccguagcacugaugaggnnnnnnnnccgaaaauccagg

SEQ ID NO: 7434 - RNA, 38 nt, Artificial Sequence
  Description of Artificial Sequence:  Enzymatic Nucleic Acid
  misc_feature (18)..(25): n stands for any nucleotide and can be optionally absent
acuguccgcugaugaggnnnnnnnnccgaaagcagaau

SEQ ID NO: 7435 - RNA, 38 nt, Artificial Sequence
  Description of Artificial Sequence:  Enzymatic Nucleic Acid
  misc_feature (18)..(25): n stands for any nucleotide and can be optionally absent
cuguuguucugaugaggnnnnnnnnccgaaacuguccg

SEQ ID NO: 7436 - RNA, 38 nt, Artificial Sequence
  Description of Artificial Sequence:  Enzymatic Nucleic Acid
  misc_feature (18)..(25): n stands for any nucleotide and can be optionally absent
ucuguugucugaugaggnnnnnnnnccgaaaacugucc

SEQ ID NO: 7437 - RNA, 38 nt, Artificial Sequence
  Description of Artificial Sequence:  Enzymatic Nucleic Acid
  misc_feature (18)..(25): n stands for any nucleotide and can be optionally absent
gcugauaccugaugaggnnnnnnnnccgaaauggugca

SEQ ID NO: 7438 - RNA, 38 nt, Artificial Sequence
  Description of Artificial Sequence:  Enzymatic Nucleic Acid
  misc_feature (18)..(25): n stands for any nucleotide and can be optionally absent
cuugcugacugaugaggnnnnnnnnccgaaacuauggu

SEQ ID NO: 7439 - RNA, 38 nt, Artificial Sequence
  Description of Artificial Sequence:  Enzymatic Nucleic Acid
  misc_feature (18)..(25): n stands for any nucleotide and can be optionally absent
ugcuugcucugaugaggnnnnnnnnccgaaauacuaug

SEQ ID NO: 7440 - RNA, 38 nt, Artificial Sequence
  Description of Artificial Sequence:  Enzymatic Nucleic Acid
  misc_feature (18)..(25): n stands for any nucleotide and can be optionally absent
guaaucuucugaugaggnnnnnnnnccgaaaguggugg

SEQ ID NO: 7441 - RNA, 38 nt, Artificial Sequence
  Description of Artificial Sequence:  Enzymatic Nucleic Acid
  misc_feature (18)..(25): n stands for any nucleotide and can be optionally absent
gauggagucugaugaggnnnnnnnnccgaaaucuugag

SEQ ID NO: 7442 - RNA, 38 nt, Artificial Sequence
  Description of Artificial Sequence:  Enzymatic Nucleic Acid
  misc_feature (18)..(25): n stands for any nucleotide and can be optionally absent
ugauggagcugaugaggnnnnnnnnccgaaaaucuuga

SEQ ID NO: 7443 - RNA, 38 nt, Artificial Sequence
  Description of Artificial Sequence:  Enzymatic Nucleic Acid
  misc_feature (18)..(25): n stands for any nucleotide and can be optionally absent
gagugaugcugaugaggnnnnnnnnccgaaaguaaucu

SEQ ID NO: 7444 - RNA, 38 nt, Artificial Sequence
  Description of Artificial Sequence:  Enzymatic Nucleic Acid
  misc_feature (18)..(25): n stands for any nucleotide and can be optionally absent
uucagagucugaugaggnnnnnnnnccgaaauggagua

SEQ ID NO: 7445 - RNA, 38 nt, Artificial Sequence
  Description of Artificial Sequence:  Enzymatic Nucleic Acid
  misc_feature (18)..(25): n stands for any nucleotide and can be optionally absent
aagguucacugaugaggnnnnnnnnccgaaagugaugg

SEQ ID NO: 7446 - RNA, 38 nt, Artificial Sequence
  Description of Artificial Sequence:  Enzymatic Nucleic Acid
  misc_feature (18)..(25): n stands for any nucleotide and can be optionally absent
uugaugaccugaugaggnnnnnnnnccgaaagguucag

SEQ ID NO: 7447 - RNA, 38 nt, Artificial Sequence
  Description of Artificial Sequence:  Enzymatic Nucleic Acid
  misc_feature (18)..(25): n stands for any nucleotide and can be optionally absent
uucuugaucugaugaggnnnnnnnnccgaaacaagguu

SEQ ID NO: 7448 - RNA, 38 nt, Artificial Sequence
  Description of Artificial Sequence:  Enzymatic Nucleic Acid
  misc_feature (18)..(25): n stands for any nucleotide and can be optionally absent
acguucuucugaugaggnnnnnnnnccgaaaugacaag

SEQ ID NO: 7449 - RNA, 38 nt, Artificial Sequence
  Description of Artificial Sequence:  Enzymatic Nucleic Acid
  misc_feature (18)..(25): n stands for any nucleotide and can be optionally absent
cuucuagacugaugaggnnnnnnnnccgaaacacguuc

SEQ ID NO: 7450 - RNA, 38 nt, Artificial Sequence
  Description of Artificial Sequence:  Enzymatic Nucleic Acid
  misc_feature (18)..(25): n stands for any nucleotide and can be optionally absent
gucuucuacugaugaggnnnnnnnnccgaaagacacgu

SEQ ID NO: 7451 - RNA, 38 nt, Artificial Sequence
  Description of Artificial Sequence:  Enzymatic Nucleic Acid
  misc_feature (18)..(25): n stands for any nucleotide and can be optionally absent
gagucuuccugaugaggnnnnnnnnccgaaagagacac

SEQ ID NO: 7452 - RNA, 38 nt, Artificial Sequence
  Description of Artificial Sequence:  Enzymatic Nucleic Acid
  misc_feature (18)..(25): n stands for any nucleotide and can be optionally absent
aggugccccugaugaggnnnnnnnnccgaaagucuucu

SEQ ID NO: 7453 - RNA, 38 nt, Artificial Sequence
  Description of Artificial Sequence:  Enzymatic Nucleic Acid
  misc_feature (18)..(25): n stands for any nucleotide and can be optionally absent
ugcacgcacugaugaggnnnnnnnnccgaaaggugccc

SEQ ID NO: 7454 - RNA, 38 nt, Artificial Sequence
  Description of Artificial Sequence:  Enzymatic Nucleic Acid
  misc_feature (18)..(25): n stands for any nucleotide and can be optionally absent
ccuguguacugaugaggnnnnnnnnccgaaauguuccu

SEQ ID NO: 7455 - RNA, 38 nt, Artificial Sequence
  Description of Artificial Sequence:  Enzymatic Nucleic Acid
  misc_feature (18)..(25): n stands for any nucleotide and can be optionally absent
ccccugugcugaugaggnnnnnnnnccgaaauauguuc

SEQ ID NO: 7456 - RNA, 38 nt, Artificial Sequence
  Description of Artificial Sequence:  Enzymatic Nucleic Acid
  misc_feature (18)..(25): n stands for any nucleotide and can be optionally absent
uuccgaagcugaugaggnnnnnnnnccgaaaugucuuc

SEQ ID NO: 7457 - RNA, 38 nt, Artificial Sequence
  Description of Artificial Sequence:  Enzymatic Nucleic Acid
  misc_feature (18)..(25): n stands for any nucleotide and can be optionally absent
gucuuccgcugaugaggnnnnnnnnccgaaaggauguc

SEQ ID NO: 7458 - RNA, 38 nt, Artificial Sequence
  Description of Artificial Sequence:  Enzymatic Nucleic Acid
  misc_feature (18)..(25): n stands for any nucleotide and can be optionally absent
ugucuucccugaugaggnnnnnnnnccgaaaaggaugu

SEQ ID NO: 7459 - RNA, 38 nt, Artificial Sequence
  Description of Artificial Sequence:  Enzymatic Nucleic Acid
  misc_feature (18)..(25): n stands for any nucleotide and can be optionally absent
cuaacgagcugaugaggnnnnnnnnccgaaacuucugu

SEQ ID NO: 7460 - RNA, 38 nt, Artificial Sequence
  Description of Artificial Sequence:  Enzymatic Nucleic Acid
  misc_feature (18)..(25): n stands for any nucleotide and can be optionally absent
ucuaacgacugaugaggnnnnnnnnccgaaaacuucug

SEQ ID NO: 7461 - RNA, 38 nt, Artificial Sequence
  Description of Artificial Sequence:  Enzymatic Nucleic Acid
  misc_feature (18)..(25): n stands for any nucleotide and can be optionally absent
ucucuaaccugaugaggnnnnnnnnccgaaagaacuuc

SEQ ID NO: 7462 - RNA, 38 nt, Artificial Sequence
  Description of Artificial Sequence:  Enzymatic Nucleic Acid
  misc_feature (18)..(25): n stands for any nucleotide and can be optionally absent
gaaucucucugaugaggnnnnnnnnccgaaacgagaac

SEQ ID NO: 7463 - RNA, 38 nt, Artificial Sequence
  Description of Artificial Sequence:  Enzymatic Nucleic Acid
  misc_feature (18)..(25): n stands for any nucleotide and can be optionally absent
cgaaucuccugaugaggnnnnnnnnccgaaaacgagaa

SEQ ID NO: 7464 - RNA, 38 nt, Artificial Sequence
  Description of Artificial Sequence:  Enzymatic Nucleic Acid
  misc_feature (18)..(25): n stands for any nucleotide and can be optionally absent
cgcuuccgcugaugaggnnnnnnnnccgaaaucucuaa

SEQ ID NO: 7465 - RNA, 38 nt, Artificial Sequence
  Description of Artificial Sequence:  Enzymatic Nucleic Acid
  misc_feature (18)..(25): n stands for any nucleotide and can be optionally absent
gcgcuucccugaugaggnnnnnnnnccgaaaaucucua

SEQ ID NO: 7466 - RNA, 38 nt, Artificial Sequence
  Description of Artificial Sequence:  Enzymatic Nucleic Acid
  misc_feature (18)..(25): n stands for any nucleotide and can be optionally absent
agguuuugcugaugaggnnnnnnnnccgaaagcaggug

SEQ ID NO: 7467 - RNA, 38 nt, Artificial Sequence
  Description of Artificial Sequence:  Enzymatic Nucleic Acid
  misc_feature (18)..(25): n stands for any nucleotide and can be optionally absent
gagguuuucugaugaggnnnnnnnnccgaaaagcaggu

SEQ ID NO: 7468 - RNA, 38 nt, Artificial Sequence
  Description of Artificial Sequence:  Enzymatic Nucleic Acid
  misc_feature (18)..(25): n stands for any nucleotide and can be optionally absent
uagucacucugaugaggnnnnnnnnccgaaagguuuug

SEQ ID NO: 7469 - RNA, 38 nt, Artificial Sequence
  Description of Artificial Sequence:  Enzymatic Nucleic Acid
  misc_feature (18)..(25): n stands for any nucleotide and can be optionally absent
agaccucgcugaugaggnnnnnnnnccgaaagucacug

SEQ ID NO: 7470 - RNA, 38 nt, Artificial Sequence
  Description of Artificial Sequence:  Enzymatic Nucleic Acid
  misc_feature (18)..(25): n stands for any nucleotide and can be optionally absent
cugauggacugaugaggnnnnnnnnccgaaaccucgua

SEQ ID NO: 7471 - RNA, 38 nt, Artificial Sequence
  Description of Artificial Sequence:  Enzymatic Nucleic Acid
  misc_feature (18)..(25): n stands for any nucleotide and can be optionally absent
cacugaugcugaugaggnnnnnnnnccgaaagaccucg

SEQ ID NO: 7472 - RNA, 38 nt, Artificial Sequence
  Description of Artificial Sequence:  Enzymatic Nucleic Acid
  misc_feature (18)..(25): n stands for any nucleotide and can be optionally absent
gagccacucugaugaggnnnnnnnnccgaaauggagac

SEQ ID NO: 7473 - RNA, 38 nt, Artificial Sequence
  Description of Artificial Sequence:  Enzymatic Nucleic Acid
  misc_feature (18)..(25): n stands for any nucleotide and can be optionally absent
aggucguacugaugaggnnnnnnnnccgaaagccacug

SEQ ID NO: 7474 - RNA, 38 nt, Artificial Sequence
  Description of Artificial Sequence:  Enzymatic Nucleic Acid
  misc_feature (18)..(25): n stands for any nucleotide and can be optionally absent
uaaggucgcugaugaggnnnnnnnnccgaaagagccac

SEQ ID NO: 7475 - RNA, 38 nt, Artificial Sequence
  Description of Artificial Sequence:  Enzymatic Nucleic Acid
  misc_feature (18)..(25): n stands for any nucleotide and can be optionally absent
gacagucucugaugaggnnnnnnnnccgaaaggucgua

SEQ ID NO: 7476 - RNA, 38 nt, Artificial Sequence
  Description of Artificial Sequence:  Enzymatic Nucleic Acid
  misc_feature (18)..(25): n stands for any nucleotide and can be optionally absent
ugacaguccugaugaggnnnnnnnnccgaaaaggucgu

SEQ ID NO: 7477 - RNA, 38 nt, Artificial Sequence
  Description of Artificial Sequence:  Enzymatic Nucleic Acid
  misc_feature (18)..(25): n stands for any nucleotide and can be optionally absent
ucuagcuucugaugaggnnnnnnnnccgaaacagucua

SEQ ID NO: 7478 - RNA, 38 nt, Artificial Sequence
  Description of Artificial Sequence:  Enzymatic Nucleic Acid
  misc_feature (18)..(25): n stands for any nucleotide and can be optionally absent
gacaccuccugaugaggnnnnnnnnccgaaagcuugac

SEQ ID NO: 7479 - RNA, 38 nt, Artificial Sequence
  Description of Artificial Sequence:  Enzymatic Nucleic Acid
  misc_feature (18)..(25): n stands for any nucleotide and can be optionally absent
ggcgcgggcugaugaggnnnnnnnnccgaaacaccucu

SEQ ID NO: 7480 - RNA, 38 nt, Artificial Sequence
  Description of Artificial Sequence:  Enzymatic Nucleic Acid
  misc_feature (18)..(25): n stands for any nucleotide and can be optionally absent
agugaucucugaugaggnnnnnnnnccgaaaggcgcgg

SEQ ID NO: 7481 - RNA, 38 nt, Artificial Sequence
  Description of Artificial Sequence:  Enzymatic Nucleic Acid
  misc_feature (18)..(25): n stands for any nucleotide and can be optionally absent
uuugaacccugaugaggnnnnnnnnccgaaagugaucu

SEQ ID NO: 7482 - RNA, 38 nt, Artificial Sequence
  Description of Artificial Sequence:  Enzymatic Nucleic Acid
  misc_feature (18)..(25): n stands for any nucleotide and can be optionally absent
uguuuuugcugaugaggnnnnnnnnccgaaaccaagug

SEQ ID NO: 7483 - RNA, 38 nt, Artificial Sequence
  Description of Artificial Sequence:  Enzymatic Nucleic Acid
  misc_feature (18)..(25): n stands for any nucleotide and can be optionally absent
ccuaaaaucugaugaggnnnnnnnnccgaaauucccgg

SEQ ID NO: 7484 - RNA, 38 nt, Artificial Sequence
  Description of Artificial Sequence:  Enzymatic Nucleic Acid
  misc_feature (18)..(25): n stands for any nucleotide and can be optionally absent
uccuaaaacugaugaggnnnnnnnnccgaaaauucccg

SEQ ID NO: 7485 - RNA, 38 nt, Artificial Sequence
  Description of Artificial Sequence:  Enzymatic Nucleic Acid
  misc_feature (18)..(25): n stands for any nucleotide and can be optionally absent
uccucugucugaugaggnnnnnnnnccgaaacucuuuc

SEQ ID NO: 7486 - RNA, 38 nt, Artificial Sequence
  Description of Artificial Sequence:  Enzymatic Nucleic Acid
  misc_feature (18)..(25): n stands for any nucleotide and can be optionally absent
caccuauacugaugaggnnnnnnnnccgaaacacccuc

SEQ ID NO: 7487 - RNA, 38 nt, Artificial Sequence
  Description of Artificial Sequence:  Enzymatic Nucleic Acid
  misc_feature (18)..(25): n stands for any nucleotide and can be optionally absent
ggcaccuacugaugaggnnnnnnnnccgaaagacaccc

SEQ ID NO: 7488 - RNA, 38 nt, Artificial Sequence
  Description of Artificial Sequence:  Enzymatic Nucleic Acid
  misc_feature (18)..(25): n stands for any nucleotide and can be optionally absent
ucggcacccugaugaggnnnnnnnnccgaaauagacac

SEQ ID NO: 7489 - RNA, 38 nt, Artificial Sequence
  Description of Artificial Sequence:  Enzymatic Nucleic Acid
  misc_feature (18)..(25): n stands for any nucleotide and can be optionally absent
cggugaggcugaugaggnnnnnnnnccgaaaggcugcg

SEQ ID NO: 7490 - RNA, 38 nt, Artificial Sequence
  Description of Artificial Sequence:  Enzymatic Nucleic Acid
  misc_feature (18)..(25): n stands for any nucleotide and can be optionally absent
ugcacggucugaugaggnnnnnnnnccgaaagguaggc

SEQ ID NO: 7491 - RNA, 38 nt, Artificial Sequence
  Description of Artificial Sequence:  Enzymatic Nucleic Acid
  misc_feature (18)..(25): n stands for any nucleotide and can be optionally absent
acuugucucugaugaggnnnnnnnnccgaaagguuccu

SEQ ID NO: 7492 - RNA, 38 nt, Artificial Sequence
  Description of Artificial Sequence:  Enzymatic Nucleic Acid
  misc_feature (18)..(25): n stands for any nucleotide and can be optionally absent
ccagguuucugaugaggnnnnnnnnccgaaacuugucu

SEQ ID NO: 7493 - RNA, 38 nt, Artificial Sequence
  Description of Artificial Sequence:  Enzymatic Nucleic Acid
  misc_feature (18)..(25): n stands for any nucleotide and can be optionally absent
gugagcgucugaugaggnnnnnnnnccgaaaucagcuc

SEQ ID NO: 7494 - RNA, 38 nt, Artificial Sequence
  Description of Artificial Sequence:  Enzymatic Nucleic Acid
  misc_feature (18)..(25): n stands for any nucleotide and can be optionally absent
gugcacgucugaugaggnnnnnnnnccgaaagcgugau

SEQ ID NO: 7495 - RNA, 38 nt, Artificial Sequence
  Description of Artificial Sequence:  Enzymatic Nucleic Acid
  misc_feature (18)..(25): n stands for any nucleotide and can be optionally absent
agccaaaacugaugaggnnnnnnnnccgaaagggucgc

SEQ ID NO: 7496 - RNA, 38 nt, Artificial Sequence
  Description of Artificial Sequence:  Enzymatic Nucleic Acid
  misc_feature (18)..(25): n stands for any nucleotide and can be optionally absent
ggagccaacugaugaggnnnnnnnnccgaaagaggguc

SEQ ID NO: 7497 - RNA, 38 nt, Artificial Sequence
  Description of Artificial Sequence:  Enzymatic Nucleic Acid
  misc_feature (18)..(25): n stands for any nucleotide and can be optionally absent
aggagccacugaugaggnnnnnnnnccgaaaagagggu

SEQ ID NO: 7498 - RNA, 38 nt, Artificial Sequence
  Description of Artificial Sequence:  Enzymatic Nucleic Acid
  misc_feature (18)..(25): n stands for any nucleotide and can be optionally absent
aaggagcccugaugaggnnnnnnnnccgaaaaagaggg

SEQ ID NO: 7499 - RNA, 38 nt, Artificial Sequence
  Description of Artificial Sequence:  Enzymatic Nucleic Acid
  misc_feature (18)..(25): n stands for any nucleotide and can be optionally absent
guuagaagcugaugaggnnnnnnnnccgaaagccaaaa

SEQ ID NO: 7500 - RNA, 38 nt, Artificial Sequence
  Description of Artificial Sequence:  Enzymatic Nucleic Acid
  misc_feature (18)..(25): n stands for any nucleotide and can be optionally absent
agaguuagcugaugaggnnnnnnnnccgaaaggagcca

SEQ ID NO: 7501 - RNA, 38 nt, Artificial Sequence
  Description of Artificial Sequence:  Enzymatic Nucleic Acid
  misc_feature (18)..(25): n stands for any nucleotide and can be optionally absent
gagaguuacugaugaggnnnnnnnnccgaaaaggagcc

SEQ ID NO: 7502 - RNA, 38 nt, Artificial Sequence
  Description of Artificial Sequence:  Enzymatic Nucleic Acid
  misc_feature (18)..(25): n stands for any nucleotide and can be optionally absent
aagagagucugaugaggnnnnnnnnccgaaagaaggag

SEQ ID NO: 7503 - RNA, 38 nt, Artificial Sequence
  Description of Artificial Sequence:  Enzymatic Nucleic Acid
  misc_feature (18)..(25): n stands for any nucleotide and can be optionally absent
gaugaagacugaugaggnnnnnnnnccgaaaguuagaa

SEQ ID NO: 7504 - RNA, 38 nt, Artificial Sequence
  Description of Artificial Sequence:  Enzymatic Nucleic Acid
  misc_feature (18)..(25): n stands for any nucleotide and can be optionally absent
cugaugaacugaugaggnnnnnnnnccgaaagaguuag

SEQ ID NO: 7505 - RNA, 38 nt, Artificial Sequence
  Description of Artificial Sequence:  Enzymatic Nucleic Acid
  misc_feature (18)..(25): n stands for any nucleotide and can be optionally absent
uucugaugcugaugaggnnnnnnnnccgaaagagaguu

SEQ ID NO: 7506 - RNA, 38 nt, Artificial Sequence
  Description of Artificial Sequence:  Enzymatic Nucleic Acid
  misc_feature (18)..(25): n stands for any nucleotide and can be optionally absent
uuucugaucugaugaggnnnnnnnnccgaaaagagagu

SEQ ID NO: 7507 - RNA, 38 nt, Artificial Sequence
  Description of Artificial Sequence:  Enzymatic Nucleic Acid
  misc_feature (18)..(25): n stands for any nucleotide and can be optionally absent
aguuuucucugaugaggnnnnnnnnccgaaaugaagag

SEQ ID NO: 7508 - RNA, 38 nt, Artificial Sequence
  Description of Artificial Sequence:  Enzymatic Nucleic Acid
  misc_feature (18)..(25): n stands for any nucleotide and can be optionally absent
cggaagaacugaugaggnnnnnnnnccgaaaccgcuuc

SEQ ID NO: 7509 - RNA, 38 nt, Artificial Sequence
  Description of Artificial Sequence:  Enzymatic Nucleic Acid
  misc_feature (18)..(25): n stands for any nucleotide and can be optionally absent
uucggaagcugaugaggnnnnnnnnccgaaagaccgcu

SEQ ID NO: 7510 - RNA, 38 nt, Artificial Sequence
  Description of Artificial Sequence:  Enzymatic Nucleic Acid
  misc_feature (18)..(25): n stands for any nucleotide and can be optionally absent
cuucggaacugaugaggnnnnnnnnccgaaaagaccgc

SEQ ID NO: 7511 - RNA, 38 nt, Artificial Sequence
  Description of Artificial Sequence:  Enzymatic Nucleic Acid
  misc_feature (18)..(25): n stands for any nucleotide and can be optionally absent
uacuucggcugaugaggnnnnnnnnccgaaagaagacc

SEQ ID NO: 7512 - RNA, 38 nt, Artificial Sequence
  Description of Artificial Sequence:  Enzymatic Nucleic Acid
  misc_feature (18)..(25): n stands for any nucleotide and can be optionally absent
uuacuucgcugaugaggnnnnnnnnccgaaaagaagac

SEQ ID NO: 7513 - RNA, 38 nt, Artificial Sequence
  Description of Artificial Sequence:  Enzymatic Nucleic Acid
  misc_feature (18)..(25): n stands for any nucleotide and can be optionally absent
ucugucuucugaugaggnnnnnnnnccgaaacuucgga

SEQ ID NO: 7514 - RNA, 38 nt, Artificial Sequence
  Description of Artificial Sequence:  Enzymatic Nucleic Acid
  misc_feature (18)..(25): n stands for any nucleotide and can be optionally absent
uugacaggcugaugaggnnnnnnnnccgaaagucuguc

SEQ ID NO: 7515 - RNA, 38 nt, Artificial Sequence
  Description of Artificial Sequence:  Enzymatic Nucleic Acid
  misc_feature (18)..(25): n stands for any nucleotide and can be optionally absent
uaaugauucugaugaggnnnnnnnnccgaaacagguag

SEQ ID NO: 7516 - RNA, 38 nt, Artificial Sequence
  Description of Artificial Sequence:  Enzymatic Nucleic Acid
  misc_feature (18)..(25): n stands for any nucleotide and can be optionally absent
uccauaaucugaugaggnnnnnnnnccgaaauugacag

SEQ ID NO: 7517 - RNA, 38 nt, Artificial Sequence
  Description of Artificial Sequence:  Enzymatic Nucleic Acid
  misc_feature (18)..(25): n stands for any nucleotide and can be optionally absent
ggguccaucugaugaggnnnnnnnnccgaaaugauuga

SEQ ID NO: 7518 - RNA, 38 nt, Artificial Sequence
  Description of Artificial Sequence:  Enzymatic Nucleic Acid
  misc_feature (18)..(25): n stands for any nucleotide and can be optionally absent
uggguccacugaugaggnnnnnnnnccgaaaaugauug

SEQ ID NO: 7519 - RNA, 38 nt, Artificial Sequence
  Description of Artificial Sequence:  Enzymatic Nucleic Acid
  misc_feature (18)..(25): n stands for any nucleotide and can be optionally absent
uccaggggcugaugaggnnnnnnnnccgaaacuucauc

SEQ ID NO: 7520 - RNA, 38 nt, Artificial Sequence
  Description of Artificial Sequence:  Enzymatic Nucleic Acid
  misc_feature (18)..(25): n stands for any nucleotide and can be optionally absent
auccagggcugaugaggnnnnnnnnccgaaaacuucau

SEQ ID NO: 7521 - RNA, 38 nt, Artificial Sequence
  Description of Artificial Sequence:  Enzymatic Nucleic Acid
  misc_feature (18)..(25): n stands for any nucleotide and can be optionally absent
uggcaucacugaugaggnnnnnnnnccgaaagggcagc

SEQ ID NO: 7522 - RNA, 38 nt, Artificial Sequence
  Description of Artificial Sequence:  Enzymatic Nucleic Acid
  misc_feature (18)..(25): n stands for any nucleotide and can be optionally absent
cccgugcacugaugaggnnnnnnnnccgaaacucccac

SEQ ID NO: 7523 - RNA, 38 nt, Artificial Sequence
  Description of Artificial Sequence:  Enzymatic Nucleic Acid
  misc_feature (18)..(25): n stands for any nucleotide and can be optionally absent
ucccgugccugaugaggnnnnnnnnccgaaaacuccca

SEQ ID NO: 7524 - RNA, 38 nt, Artificial Sequence
  Description of Artificial Sequence:  Enzymatic Nucleic Acid
  misc_feature (18)..(25): n stands for any nucleotide and can be optionally absent
gauuugcccugaugaggnnnnnnnnccgaaaguuucag

SEQ ID NO: 7525 - RNA, 38 nt, Artificial Sequence
  Description of Artificial Sequence:  Enzymatic Nucleic Acid
  misc_feature (18)..(25): n stands for any nucleotide and can be optionally absent
uuccgagccugaugaggnnnnnnnnccgaaauuugccu

SEQ ID NO: 7526 - RNA, 38 nt, Artificial Sequence
  Description of Artificial Sequence:  Enzymatic Nucleic Acid
  misc_feature (18)..(25): n stands for any nucleotide and can be optionally absent
ccucuucccugaugaggnnnnnnnnccgaaagcgauuu

SEQ ID NO: 7527 - RNA, 38 nt, Artificial Sequence
  Description of Artificial Sequence:  Enzymatic Nucleic Acid
  misc_feature (18)..(25): n stands for any nucleotide and can be optionally absent
uuucccaacugaugaggnnnnnnnnccgaaagccccuc

SEQ ID NO: 7528 - RNA, 38 nt, Artificial Sequence
  Description of Artificial Sequence:  Enzymatic Nucleic Acid
  misc_feature (18)..(25): n stands for any nucleotide and can be optionally absent
cuuucccacugaugaggnnnnnnnnccgaaaagccccu

SEQ ID NO: 7529 - RNA, 38 nt, Artificial Sequence
  Description of Artificial Sequence:  Enzymatic Nucleic Acid
  misc_feature (18)..(25): n stands for any nucleotide and can be optionally absent
acuuuccccugaugaggnnnnnnnnccgaaaaagcccc

SEQ ID NO: 7530 - RNA, 38 nt, Artificial Sequence
  Description of Artificial Sequence:  Enzymatic Nucleic Acid
  misc_feature (18)..(25): n stands for any nucleotide and can be optionally absent
gcuugaaccugaugaggnnnnnnnnccgaaacuuuccc

SEQ ID NO: 7531 - RNA, 38 nt, Artificial Sequence
  Description of Artificial Sequence:  Enzymatic Nucleic Acid
  misc_feature (18)..(25): n stands for any nucleotide and can be optionally absent
gaggcuugcugaugaggnnnnnnnnccgaaacgacuuu

SEQ ID NO: 7532 - RNA, 38 nt, Artificial Sequence
  Description of Artificial Sequence:  Enzymatic Nucleic Acid
  misc_feature (18)..(25): n stands for any nucleotide and can be optionally absent
agaggcuucugaugaggnnnnnnnnccgaaaacgacuu

SEQ ID NO: 7533 - RNA, 38 nt, Artificial Sequence
  Description of Artificial Sequence:  Enzymatic Nucleic Acid
  misc_feature (18)..(25): n stands for any nucleotide and can be optionally absent
caaaugcacugaugaggnnnnnnnnccgaaaggcuuga

SEQ ID NO: 7534 - RNA, 38 nt, Artificial Sequence
  Description of Artificial Sequence:  Enzymatic Nucleic Acid
  misc_feature (18)..(25): n stands for any nucleotide and can be optionally absent
uaaugccacugaugaggnnnnnnnnccgaaaugcagag

SEQ ID NO: 7535 - RNA, 38 nt, Artificial Sequence
  Description of Artificial Sequence:  Enzymatic Nucleic Acid
  misc_feature (18)..(25): n stands for any nucleotide and can be optionally absent
uuaaugcccugaugaggnnnnnnnnccgaaaaugcaga

SEQ ID NO: 7536 - RNA, 38 nt, Artificial Sequence
  Description of Artificial Sequence:  Enzymatic Nucleic Acid
  misc_feature (18)..(25): n stands for any nucleotide and can be optionally absent
aggugggucugaugaggnnnnnnnnccgaaauuucuua

SEQ ID NO: 7537 - RNA, 38 nt, Artificial Sequence
  Description of Artificial Sequence:  Enzymatic Nucleic Acid
  misc_feature (18)..(25): n stands for any nucleotide and can be optionally absent
ccucuuuccugaugaggnnnnnnnnccgaaacaucuuc

SEQ ID NO: 7538 - RNA, 38 nt, Artificial Sequence
  Description of Artificial Sequence:  Enzymatic Nucleic Acid
  misc_feature (18)..(25): n stands for any nucleotide and can be optionally absent
gagcuuugcugaugaggnnnnnnnnccgaaacucacug

SEQ ID NO: 7539 - RNA, 38 nt, Artificial Sequence
  Description of Artificial Sequence:  Enzymatic Nucleic Acid
  misc_feature (18)..(25): n stands for any nucleotide and can be optionally absent
ggucaucacugaugaggnnnnnnnnccgaaagcuuugu

SEQ ID NO: 7540 - RNA, 38 nt, Artificial Sequence
  Description of Artificial Sequence:  Enzymatic Nucleic Acid
  misc_feature (18)..(25): n stands for any nucleotide and can be optionally absent
aagaucuucugaugaggnnnnnnnnccgaaaguucggu

SEQ ID NO: 7541 - RNA, 38 nt, Artificial Sequence
  Description of Artificial Sequence:  Enzymatic Nucleic Acid
  misc_feature (18)..(25): n stands for any nucleotide and can be optionally absent
ugggucaacugaugaggnnnnnnnnccgaaaucuugag

SEQ ID NO: 7542 - RNA, 38 nt, Artificial Sequence
  Description of Artificial Sequence:  Enzymatic Nucleic Acid
  misc_feature (18)..(25): n stands for any nucleotide and can be optionally absent
uguggguccugaugaggnnnnnnnnccgaaagaucuug

SEQ ID NO: 7543 - RNA, 38 nt, Artificial Sequence
  Description of Artificial Sequence:  Enzymatic Nucleic Acid
  misc_feature (18)..(25): n stands for any nucleotide and can be optionally absent
ugauggcccugaugaggnnnnnnnnccgaaaugugggu

SEQ ID NO: 7544 - RNA, 38 nt, Artificial Sequence
  Description of Artificial Sequence:  Enzymatic Nucleic Acid
  misc_feature (18)..(25): n stands for any nucleotide and can be optionally absent
auucagaucugaugaggnnnnnnnnccgaaauggccga

SEQ ID NO: 7545 - RNA, 38 nt, Artificial Sequence
  Description of Artificial Sequence:  Enzymatic Nucleic Acid
  misc_feature (18)..(25): n stands for any nucleotide and can be optionally absent
cacauucacugaugaggnnnnnnnnccgaaaugauggc

SEQ ID NO: 7546 - RNA, 38 nt, Artificial Sequence
  Description of Artificial Sequence:  Enzymatic Nucleic Acid
  misc_feature (18)..(25): n stands for any nucleotide and can be optionally absent
aggagguucugaugaggnnnnnnnnccgaaaccacauu

SEQ ID NO: 7547 - RNA, 38 nt, Artificial Sequence
  Description of Artificial Sequence:  Enzymatic Nucleic Acid
  misc_feature (18)..(25): n stands for any nucleotide and can be optionally absent
caggaggucugaugaggnnnnnnnnccgaaaaccacau

SEQ ID NO: 7548 - RNA, 38 nt, Artificial Sequence
  Description of Artificial Sequence:  Enzymatic Nucleic Acid
  misc_feature (18)..(25): n stands for any nucleotide and can be optionally absent
gcucccagcugaugaggnnnnnnnnccgaaagguuaac

SEQ ID NO: 7549 - RNA, 38 nt, Artificial Sequence
  Description of Artificial Sequence:  Enzymatic Nucleic Acid
  misc_feature (18)..(25): n stands for any nucleotide and can be optionally absent
uauuccaccugaugaggnnnnnnnnccgaaaucaccau

SEQ ID NO: 7550 - RNA, 38 nt, Artificial Sequence
  Description of Artificial Sequence:  Enzymatic Nucleic Acid
  misc_feature (18)..(25): n stands for any nucleotide and can be optionally absent
auuugcagcugaugaggnnnnnnnnccgaaauuccacg

SEQ ID NO: 7551 - RNA, 38 nt, Artificial Sequence
  Description of Artificial Sequence:  Enzymatic Nucleic Acid
  misc_feature (18)..(25): n stands for any nucleotide and can be optionally absent
gguuuccgcugaugaggnnnnnnnnccgaaauuugcag

SEQ ID NO: 7552 - RNA, 38 nt, Artificial Sequence
  Description of Artificial Sequence:  Enzymatic Nucleic Acid
  misc_feature (18)..(25): n stands for any nucleotide and can be optionally absent
gguaguugcugaugaggnnnnnnnnccgaaacagguuu

SEQ ID NO: 7553 - RNA, 38 nt, Artificial Sequence
  Description of Artificial Sequence:  Enzymatic Nucleic Acid
  misc_feature (18)..(25): n stands for any nucleotide and can be optionally absent
ucuugaggcugaugaggnnnnnnnnccgaaaguuggac

SEQ ID NO: 7554 - RNA, 38 nt, Artificial Sequence
  Description of Artificial Sequence:  Enzymatic Nucleic Acid
  misc_feature (18)..(25): n stands for any nucleotide and can be optionally absent
gacagaaucugaugaggnnnnnnnnccgaaagucacgu

SEQ ID NO: 7555 - RNA, 38 nt, Artificial Sequence
  Description of Artificial Sequence:  Enzymatic Nucleic Acid
  misc_feature (18)..(25): n stands for any nucleotide and can be optionally absent
agacagaacugaugaggnnnnnnnnccgaaaagucacg

SEQ ID NO: 7556 - RNA, 38 nt, Artificial Sequence
  Description of Artificial Sequence:  Enzymatic Nucleic Acid
  misc_feature (18)..(25): n stands for any nucleotide and can be optionally absent
ugagacagcugaugaggnnnnnnnnccgaaauaaguca

SEQ ID NO: 7557 - RNA, 38 nt, Artificial Sequence
  Description of Artificial Sequence:  Enzymatic Nucleic Acid
  misc_feature (18)..(25): n stands for any nucleotide and can be optionally absent
uugagacacugaugaggnnnnnnnnccgaaaauaaguc

SEQ ID NO: 7558 - RNA, 38 nt, Artificial Sequence
  Description of Artificial Sequence:  Enzymatic Nucleic Acid
  misc_feature (18)..(25): n stands for any nucleotide and can be optionally absent
cuuguugacugaugaggnnnnnnnnccgaaacagaaua

SEQ ID NO: 7559 - RNA, 38 nt, Artificial Sequence
  Description of Artificial Sequence:  Enzymatic Nucleic Acid
  misc_feature (18)..(25): n stands for any nucleotide and can be optionally absent
uccuuguucugaugaggnnnnnnnnccgaaagacagaa

SEQ ID NO: 7560 - RNA, 38 nt, Artificial Sequence
  Description of Artificial Sequence:  Enzymatic Nucleic Acid
  misc_feature (18)..(25): n stands for any nucleotide and can be optionally absent
ccauaugccugaugaggnnnnnnnnccgaaaggcugcg

SEQ ID NO: 7561 - RNA, 38 nt, Artificial Sequence
  Description of Artificial Sequence:  Enzymatic Nucleic Acid
  misc_feature (18)..(25): n stands for any nucleotide and can be optionally absent
gagcuccacugaugaggnnnnnnnnccgaaaugcaagg

SEQ ID NO: 7562 - RNA, 38 nt, Artificial Sequence
  Description of Artificial Sequence:  Enzymatic Nucleic Acid
  misc_feature (18)..(25): n stands for any nucleotide and can be optionally absent
ucuuucuucugaugaggnnnnnnnnccgaaagcuccau

SEQ ID NO: 7563 - RNA, 38 nt, Artificial Sequence
  Description of Artificial Sequence:  Enzymatic Nucleic Acid
  misc_feature (18)..(25): n stands for any nucleotide and can be optionally absent
acacuguccugaugaggnnnnnnnnccgaaaggcgggg

SEQ ID NO: 7564 - RNA, 38 nt, Artificial Sequence
  Description of Artificial Sequence:  Enzymatic Nucleic Acid
  misc_feature (18)..(25): n stands for any nucleotide and can be optionally absent
gagcugcucugaugaggnnnnnnnnccgaaacacuguc

SEQ ID NO: 7565 - RNA, 38 nt, Artificial Sequence
  Description of Artificial Sequence:  Enzymatic Nucleic Acid
  misc_feature (18)..(25): n stands for any nucleotide and can be optionally absent
ugacacuucugaugaggnnnnnnnnccgaaagcugcug

SEQ ID NO: 7566 - RNA, 38 nt, Artificial Sequence
  Description of Artificial Sequence:  Enzymatic Nucleic Acid
  misc_feature (18)..(25): n stands for any nucleotide and can be optionally absent
gagcuggucugaugaggnnnnnnnnccgaaacacuuga

SEQ ID NO: 7567 - RNA, 38 nt, Artificial Sequence
  Description of Artificial Sequence:  Enzymatic Nucleic Acid
  misc_feature (18)..(25): n stands for any nucleotide and can be optionally absent
ggaagcugcugaugaggnnnnnnnnccgaaagcuggug

SEQ ID NO: 7568 - RNA, 38 nt, Artificial Sequence
  Description of Artificial Sequence:  Enzymatic Nucleic Acid
  misc_feature (18)..(25): n stands for any nucleotide and can be optionally absent
cuucagggcugaugaggnnnnnnnnccgaaagcuggag

SEQ ID NO: 7569 - RNA, 38 nt, Artificial Sequence
  Description of Artificial Sequence:  Enzymatic Nucleic Acid
  misc_feature (18)..(25): n stands for any nucleotide and can be optionally absent
ucuucaggcugaugaggnnnnnnnnccgaaaagcugga

SEQ ID NO: 7570 - RNA, 38 nt, Artificial Sequence
  Description of Artificial Sequence:  Enzymatic Nucleic Acid
  misc_feature (18)..(25): n stands for any nucleotide and can be optionally absent
cucacugucugaugaggnnnnnnnnccgaaauccucgu

SEQ ID NO: 7571 - RNA, 38 nt, Artificial Sequence
  Description of Artificial Sequence:  Enzymatic Nucleic Acid
  misc_feature (18)..(25): n stands for any nucleotide and can be optionally absent
ucucacugcugaugaggnnnnnnnnccgaaaauccucg

SEQ ID NO: 7572 - RNA, 38 nt, Artificial Sequence
  Description of Artificial Sequence:  Enzymatic Nucleic Acid
  misc_feature (18)..(25): n stands for any nucleotide and can be optionally absent
ugcuuggacugaugaggnnnnnnnnccgaaaucucacu

SEQ ID NO: 7573 - RNA, 38 nt, Artificial Sequence
  Description of Artificial Sequence:  Enzymatic Nucleic Acid
  misc_feature (18)..(25): n stands for any nucleotide and can be optionally absent
gcugcuugcugaugaggnnnnnnnnccgaaagaucuca

SEQ ID NO: 7574 - RNA, 38 nt, Artificial Sequence
  Description of Artificial Sequence:  Enzymatic Nucleic Acid
  misc_feature (18)..(25): n stands for any nucleotide and can be optionally absent
uccauggucugaugaggnnnnnnnnccgaaaggggcug

SEQ ID NO: 7575 - RNA, 38 nt, Artificial Sequence
  Description of Artificial Sequence:  Enzymatic Nucleic Acid
  misc_feature (18)..(25): n stands for any nucleotide and can be optionally absent
cuguaggacugaugaggnnnnnnnnccgaaaucagguc

SEQ ID NO: 7576 - RNA, 38 nt, Artificial Sequence
  Description of Artificial Sequence:  Enzymatic Nucleic Acid
  misc_feature (18)..(25): n stands for any nucleotide and can be optionally absent
acuguaggcugaugaggnnnnnnnnccgaaaaucaggu

SEQ ID NO: 7577 - RNA, 38 nt, Artificial Sequence
  Description of Artificial Sequence:  Enzymatic Nucleic Acid
  misc_feature (18)..(25): n stands for any nucleotide and can be optionally absent
aacuguagcugaugaggnnnnnnnnccgaaaaaucagg

SEQ ID NO: 7578 - RNA, 38 nt, Artificial Sequence
  Description of Artificial Sequence:  Enzymatic Nucleic Acid
  misc_feature (18)..(25): n stands for any nucleotide and can be optionally absent
ggaaacugcugaugaggnnnnnnnnccgaaaggaaauc

SEQ ID NO: 7579 - RNA, 38 nt, Artificial Sequence
  Description of Artificial Sequence:  Enzymatic Nucleic Acid
  misc_feature (18)..(25): n stands for any nucleotide and can be optionally absent
cacuuggacugaugaggnnnnnnnnccgaaacuguagg

SEQ ID NO: 7580 - RNA, 38 nt, Artificial Sequence
  Description of Artificial Sequence:  Enzymatic Nucleic Acid
  misc_feature (18)..(25): n stands for any nucleotide and can be optionally absent
ccacuuggcugaugaggnnnnnnnnccgaaaacuguag

SEQ ID NO: 7581 - RNA, 38 nt, Artificial Sequence
  Description of Artificial Sequence:  Enzymatic Nucleic Acid
  misc_feature (18)..(25): n stands for any nucleotide and can be optionally absent
aggacagacugaugaggnnnnnnnnccgaaacuccaug

SEQ ID NO: 7582 - RNA, 38 nt, Artificial Sequence
  Description of Artificial Sequence:  Enzymatic Nucleic Acid
  misc_feature (18)..(25): n stands for any nucleotide and can be optionally absent
gaggacagcugaugaggnnnnnnnnccgaaaacuccau

SEQ ID NO: 7583 - RNA, 38 nt, Artificial Sequence
  Description of Artificial Sequence:  Enzymatic Nucleic Acid
  misc_feature (18)..(25): n stands for any nucleotide and can be optionally absent
ggaggacacugaugaggnnnnnnnnccgaaaaacucca

SEQ ID NO: 7584 - RNA, 38 nt, Artificial Sequence
  Description of Artificial Sequence:  Enzymatic Nucleic Acid
  misc_feature (18)..(25): n stands for any nucleotide and can be optionally absent
uucuggagcugaugaggnnnnnnnnccgaaacagaaac

SEQ ID NO: 7585 - RNA, 38 nt, Artificial Sequence
  Description of Artificial Sequence:  Enzymatic Nucleic Acid
  misc_feature (18)..(25): n stands for any nucleotide and can be optionally absent
acuuucugcugaugaggnnnnnnnnccgaaaggacaga

SEQ ID NO: 7586 - RNA, 38 nt, Artificial Sequence
  Description of Artificial Sequence:  Enzymatic Nucleic Acid
  misc_feature (18)..(25): n stands for any nucleotide and can be optionally absent
ucagauaacugaugaggnnnnnnnnccgaaaggauguu

SEQ ID NO: 7587 - RNA, 38 nt, Artificial Sequence
  Description of Artificial Sequence:  Enzymatic Nucleic Acid
  misc_feature (18)..(25): n stands for any nucleotide and can be optionally absent
cucagauacugaugaggnnnnnnnnccgaaaaggaugu

SEQ ID NO: 7588 - RNA, 38 nt, Artificial Sequence
  Description of Artificial Sequence:  Enzymatic Nucleic Acid
  misc_feature (18)..(25): n stands for any nucleotide and can be optionally absent
ucucagaucugaugaggnnnnnnnnccgaaaaaggaug

SEQ ID NO: 7589 - RNA, 38 nt, Artificial Sequence
  Description of Artificial Sequence:  Enzymatic Nucleic Acid
  misc_feature (18)..(25): n stands for any nucleotide and can be optionally absent
uucucagacugaugaggnnnnnnnnccgaaaaaaggau

SEQ ID NO: 7590 - RNA, 38 nt, Artificial Sequence
  Description of Artificial Sequence:  Enzymatic Nucleic Acid
  misc_feature (18)..(25): n stands for any nucleotide and can be optionally absent
uguucucacugaugaggnnnnnnnnccgaaauaaaagg

SEQ ID NO: 7591 - RNA, 38 nt, Artificial Sequence
  Description of Artificial Sequence:  Enzymatic Nucleic Acid
  misc_feature (18)..(25): n stands for any nucleotide and can be optionally absent
aagucgcacugaugaggnnnnnnnnccgaaaucuucac

SEQ ID NO: 7592 - RNA, 38 nt, Artificial Sequence
  Description of Artificial Sequence:  Enzymatic Nucleic Acid
  misc_feature (18)..(25): n stands for any nucleotide and can be optionally absent
aaagucgccugaugaggnnnnnnnnccgaaaaucuuca

SEQ ID NO: 7593 - RNA, 38 nt, Artificial Sequence
  Description of Artificial Sequence:  Enzymatic Nucleic Acid
  misc_feature (18)..(25): n stands for any nucleotide and can be optionally absent
ccaggccacugaugaggnnnnnnnnccgaaagucgcaa

SEQ ID NO: 7594 - RNA, 38 nt, Artificial Sequence
  Description of Artificial Sequence:  Enzymatic Nucleic Acid
  misc_feature (18)..(25): n stands for any nucleotide and can be optionally absent
gccaggcccugaugaggnnnnnnnnccgaaaagucgca

SEQ ID NO: 7595 - RNA, 38 nt, Artificial Sequence
  Description of Artificial Sequence:  Enzymatic Nucleic Acid
  misc_feature (18)..(25): n stands for any nucleotide and can be optionally absent
aggguucucugaugaggnnnnnnnnccgaaauaaauau

SEQ ID NO: 7596 - RNA, 38 nt, Artificial Sequence
  Description of Artificial Sequence:  Enzymatic Nucleic Acid
  misc_feature (18)..(25): n stands for any nucleotide and can be optionally absent
ccucacaucugaugaggnnnnnnnnccgaaaucagggu

SEQ ID NO: 7597 - RNA, 38 nt, Artificial Sequence
  Description of Artificial Sequence:  Enzymatic Nucleic Acid
  misc_feature (18)..(25): n stands for any nucleotide and can be optionally absent
uccucacacugaugaggnnnnnnnnccgaaaaucaggg

SEQ ID NO: 7598 - RNA, 38 nt, Artificial Sequence
  Description of Artificial Sequence:  Enzymatic Nucleic Acid
  misc_feature (18)..(25): n stands for any nucleotide and can be optionally absent
aagucgagcugaugaggnnnnnnnnccgaaaucuccuc

SEQ ID NO: 7599 - RNA, 38 nt, Artificial Sequence
  Description of Artificial Sequence:  Enzymatic Nucleic Acid
  misc_feature (18)..(25): n stands for any nucleotide and can be optionally absent
gggaaguccugaugaggnnnnnnnnccgaaaguaucuc

SEQ ID NO: 7600 - RNA, 38 nt, Artificial Sequence
  Description of Artificial Sequence:  Enzymatic Nucleic Acid
  misc_feature (18)..(25): n stands for any nucleotide and can be optionally absent
uuuaggggcugaugaggnnnnnnnnccgaaagucgagu

SEQ ID NO: 7601 - RNA, 38 nt, Artificial Sequence
  Description of Artificial Sequence:  Enzymatic Nucleic Acid
  misc_feature (18)..(25): n stands for any nucleotide and can be optionally absent
uuuuagggcugaugaggnnnnnnnnccgaaaagucgag

SEQ ID NO: 7602 - RNA, 38 nt, Artificial Sequence
  Description of Artificial Sequence:  Enzymatic Nucleic Acid
  misc_feature (18)..(25): n stands for any nucleotide and can be optionally absent
auccauuucugaugaggnnnnnnnnccgaaaggggaag

SEQ ID NO: 7603 - RNA, 38 nt, Artificial Sequence
  Description of Artificial Sequence:  Enzymatic Nucleic Acid
  misc_feature (18)..(25): n stands for any nucleotide and can be optionally absent
ggauucagcugaugaggnnnnnnnnccgaaagccaucc

SEQ ID NO: 7604 - RNA, 38 nt, Artificial Sequence
  Description of Artificial Sequence:  Enzymatic Nucleic Acid
  misc_feature (18)..(25): n stands for any nucleotide and can be optionally absent
caaagaugcugaugaggnnnnnnnnccgaaauucagga

SEQ ID NO: 7605 - RNA, 38 nt, Artificial Sequence
  Description of Artificial Sequence:  Enzymatic Nucleic Acid
  misc_feature (18)..(25): n stands for any nucleotide and can be optionally absent
uugucaaacugaugaggnnnnnnnnccgaaauggauuc

SEQ ID NO: 7606 - RNA, 38 nt, Artificial Sequence
  Description of Artificial Sequence:  Enzymatic Nucleic Acid
  misc_feature (18)..(25): n stands for any nucleotide and can be optionally absent
ccuugucacugaugaggnnnnnnnnccgaaagauggau

SEQ ID NO: 7607 - RNA, 38 nt, Artificial Sequence
  Description of Artificial Sequence:  Enzymatic Nucleic Acid
  misc_feature (18)..(25): n stands for any nucleotide and can be optionally absent
accuuguccugaugaggnnnnnnnnccgaaaagaugga

SEQ ID NO: 7608 - RNA, 38 nt, Artificial Sequence
  Description of Artificial Sequence:  Enzymatic Nucleic Acid
  misc_feature (18)..(25): n stands for any nucleotide and can be optionally absent
gugcuguacugaugaggnnnnnnnnccgaaaccuuguc

SEQ ID NO: 7609 - RNA, 38 nt, Artificial Sequence
  Description of Artificial Sequence:  Enzymatic Nucleic Acid
  misc_feature (18)..(25): n stands for any nucleotide and can be optionally absent
uggugcugcugaugaggnnnnnnnnccgaaagaccuug

SEQ ID NO: 7610 - RNA, 38 nt, Artificial Sequence
  Description of Artificial Sequence:  Enzymatic Nucleic Acid
  misc_feature (18)..(25): n stands for any nucleotide and can be optionally absent
cgccauagcugaugaggnnnnnnnnccgaaaccacaca

SEQ ID NO: 7611 - RNA, 38 nt, Artificial Sequence
  Description of Artificial Sequence:  Enzymatic Nucleic Acid
  misc_feature (18)..(25): n stands for any nucleotide and can be optionally absent
acacgccacugaugaggnnnnnnnnccgaaaggaccac

SEQ ID NO: 7612 - RNA, 38 nt, Artificial Sequence
  Description of Artificial Sequence:  Enzymatic Nucleic Acid
  misc_feature (18)..(25): n stands for any nucleotide and can be optionally absent
cccacagccugaugaggnnnnnnnnccgaaacacgcca

SEQ ID NO: 7613 - RNA, 38 nt, Artificial Sequence
  Description of Artificial Sequence:  Enzymatic Nucleic Acid
  misc_feature (18)..(25): n stands for any nucleotide and can be optionally absent
aaggagaacugaugaggnnnnnnnnccgaaaucuccca

SEQ ID NO: 7614 - RNA, 38 nt, Artificial Sequence
  Description of Artificial Sequence:  Enzymatic Nucleic Acid
  misc_feature (18)..(25): n stands for any nucleotide and can be optionally absent
cuaaggagcugaugaggnnnnnnnnccgaaagaucucc

SEQ ID NO: 7615 - RNA, 38 nt, Artificial Sequence
  Description of Artificial Sequence:  Enzymatic Nucleic Acid
  misc_feature (18)..(25): n stands for any nucleotide and can be optionally absent
ccuaaggacugaugaggnnnnnnnnccgaaaagaucuc

SEQ ID NO: 7616 - RNA, 38 nt, Artificial Sequence
  Description of Artificial Sequence:  Enzymatic Nucleic Acid
  misc_feature (18)..(25): n stands for any nucleotide and can be optionally absent
ccccuaagcugaugaggnnnnnnnnccgaaagaagauc

SEQ ID NO: 7617 - RNA, 38 nt, Artificial Sequence
  Description of Artificial Sequence:  Enzymatic Nucleic Acid
  misc_feature (18)..(25): n stands for any nucleotide and can be optionally absent
aacccccucugaugaggnnnnnnnnccgaaaggagaag

SEQ ID NO: 7618 - RNA, 38 nt, Artificial Sequence
  Description of Artificial Sequence:  Enzymatic Nucleic Acid
  misc_feature (18)..(25): n stands for any nucleotide and can be optionally absent
gaaccccccugaugaggnnnnnnnnccgaaaaggagaa

SEQ ID NO: 7619 - RNA, 38 nt, Artificial Sequence
  Description of Artificial Sequence:  Enzymatic Nucleic Acid
  misc_feature (18)..(25): n stands for any nucleotide and can be optionally absent
guauggagcugaugaggnnnnnnnnccgaaacccccua

SEQ ID NO: 7620 - RNA, 38 nt, Artificial Sequence
  Description of Artificial Sequence:  Enzymatic Nucleic Acid
  misc_feature (18)..(25): n stands for any nucleotide and can be optionally absent
gguauggacugaugaggnnnnnnnnccgaaaacccccu

SEQ ID NO: 7621 - RNA, 38 nt, Artificial Sequence
  Description of Artificial Sequence:  Enzymatic Nucleic Acid
  misc_feature (18)..(25): n stands for any nucleotide and can be optionally absent
uggguaugcugaugaggnnnnnnnnccgaaagaacccc

SEQ ID NO: 7622 - RNA, 38 nt, Artificial Sequence
  Description of Artificial Sequence:  Enzymatic Nucleic Acid
  misc_feature (18)..(25): n stands for any nucleotide and can be optionally absent
cuccugggcugaugaggnnnnnnnnccgaaauggagaa

SEQ ID NO: 7623 - RNA, 38 nt, Artificial Sequence
  Description of Artificial Sequence:  Enzymatic Nucleic Acid
  misc_feature (18)..(25): n stands for any nucleotide and can be optionally absent
ggcugcagcugaugaggnnnnnnnnccgaaagucuuca

SEQ ID NO: 7624 - RNA, 38 nt, Artificial Sequence
  Description of Artificial Sequence:  Enzymatic Nucleic Acid
  misc_feature (18)..(25): n stands for any nucleotide and can be optionally absent
cggcugcacugaugaggnnnnnnnnccgaaaagucuuc

SEQ ID NO: 7625 - RNA, 38 nt, Artificial Sequence
  Description of Artificial Sequence:  Enzymatic Nucleic Acid
  misc_feature (18)..(25): n stands for any nucleotide and can be optionally absent
guguggcacugaugaggnnnnnnnnccgaaacuccggg

SEQ ID NO: 7626 - RNA, 38 nt, Artificial Sequence
  Description of Artificial Sequence:  Enzymatic Nucleic Acid
  misc_feature (18)..(25): n stands for any nucleotide and can be optionally absent
auuugguacugaugaggnnnnnnnnccgaaauuucagg

SEQ ID NO: 7627 - RNA, 38 nt, Artificial Sequence
  Description of Artificial Sequence:  Enzymatic Nucleic Acid
  misc_feature (18)..(25): n stands for any nucleotide and can be optionally absent
ugauuuggcugaugaggnnnnnnnnccgaaagauuuca

SEQ ID NO: 7628 - RNA, 38 nt, Artificial Sequence
  Description of Artificial Sequence:  Enzymatic Nucleic Acid
  misc_feature (18)..(25): n stands for any nucleotide and can be optionally absent
uccaacaucugaugaggnnnnnnnnccgaaauuuggua

SEQ ID NO: 7629 - RNA, 38 nt, Artificial Sequence
  Description of Artificial Sequence:  Enzymatic Nucleic Acid
  misc_feature (18)..(25): n stands for any nucleotide and can be optionally absent
agcaaucccugaugaggnnnnnnnnccgaaacaugauu

SEQ ID NO: 7630 - RNA, 38 nt, Artificial Sequence
  Description of Artificial Sequence:  Enzymatic Nucleic Acid
  misc_feature (18)..(25): n stands for any nucleotide and can be optionally absent
gugccagccugaugaggnnnnnnnnccgaaauccaaca

SEQ ID NO: 7631 - RNA, 38 nt, Artificial Sequence
  Description of Artificial Sequence:  Enzymatic Nucleic Acid
  misc_feature (18)..(25): n stands for any nucleotide and can be optionally absent
guucagcacugaugaggnnnnnnnnccgaaaccggggc

SEQ ID NO: 7632 - RNA, 38 nt, Artificial Sequence
  Description of Artificial Sequence:  Enzymatic Nucleic Acid
  misc_feature (18)..(25): n stands for any nucleotide and can be optionally absent
aguucagccugaugaggnnnnnnnnccgaaaaccgggg

SEQ ID NO: 7633 - RNA, 38 nt, Artificial Sequence
  Description of Artificial Sequence:  Enzymatic Nucleic Acid
  misc_feature (18)..(25): n stands for any nucleotide and can be optionally absent
uucuccaccugaugaggnnnnnnnnccgaaaguucagc

SEQ ID NO: 7634 - RNA, 38 nt, Artificial Sequence
  Description of Artificial Sequence:  Enzymatic Nucleic Acid
  misc_feature (18)..(25): n stands for any nucleotide and can be optionally absent
aggucacccugaugaggnnnnnnnnccgaaaguuucuc

SEQ ID NO: 7635 - RNA, 38 nt, Artificial Sequence
  Description of Artificial Sequence:  Enzymatic Nucleic Acid
  misc_feature (18)..(25): n stands for any nucleotide and can be optionally absent
uuggcuugcugaugaggnnnnnnnnccgaaagcagguc

SEQ ID NO: 7636 - RNA, 38 nt, Artificial Sequence
  Description of Artificial Sequence:  Enzymatic Nucleic Acid
  misc_feature (18)..(25): n stands for any nucleotide and can be optionally absent
guuggcuucugaugaggnnnnnnnnccgaaaagcaggu

SEQ ID NO: 7637 - RNA, 38 nt, Artificial Sequence
  Description of Artificial Sequence:  Enzymatic Nucleic Acid
  misc_feature (18)..(25): n stands for any nucleotide and can be optionally absent
uccuguugcugaugaggnnnnnnnnccgaaacguuggc

SEQ ID NO: 7638 - RNA, 38 nt, Artificial Sequence
  Description of Artificial Sequence:  Enzymatic Nucleic Acid
  misc_feature (18)..(25): n stands for any nucleotide and can be optionally absent
ggggaugucugaugaggnnnnnnnnccgaaaucuuucc

SEQ ID NO: 7639 - RNA, 38 nt, Artificial Sequence
  Description of Artificial Sequence:  Enzymatic Nucleic Acid
  misc_feature (18)..(25): n stands for any nucleotide and can be optionally absent
gggggaugcugaugaggnnnnnnnnccgaaaaucuuuc

SEQ ID NO: 7640 - RNA, 38 nt, Artificial Sequence
  Description of Artificial Sequence:  Enzymatic Nucleic Acid
  misc_feature (18)..(25): n stands for any nucleotide and can be optionally absent
uugaggggcugaugaggnnnnnnnnccgaaauguaauc

SEQ ID NO: 7641 - RNA, 38 nt, Artificial Sequence
  Description of Artificial Sequence:  Enzymatic Nucleic Acid
  misc_feature (18)..(25): n stands for any nucleotide and can be optionally absent
auggcauucugaugaggnnnnnnnnccgaaagggggau

SEQ ID NO: 7642 - RNA, 38 nt, Artificial Sequence
  Description of Artificial Sequence:  Enzymatic Nucleic Acid
  misc_feature (18)..(25): n stands for any nucleotide and can be optionally absent
cuagucagcugaugaggnnnnnnnnccgaaauggcauu

SEQ ID NO: 7643 - RNA, 38 nt, Artificial Sequence
  Description of Artificial Sequence:  Enzymatic Nucleic Acid
  misc_feature (18)..(25): n stands for any nucleotide and can be optionally absent
acuguuuccugaugaggnnnnnnnnccgaaagucagua

SEQ ID NO: 7644 - RNA, 38 nt, Artificial Sequence
  Description of Artificial Sequence:  Enzymatic Nucleic Acid
  misc_feature (18)..(25): n stands for any nucleotide and can be optionally absent
ugugaagccugaugaggnnnnnnnnccgaaacuguuuc

SEQ ID NO: 7645 - RNA, 38 nt, Artificial Sequence
  Description of Artificial Sequence:  Enzymatic Nucleic Acid
  misc_feature (18)..(25): n stands for any nucleotide and can be optionally absent
aguaugugcugaugaggnnnnnnnnccgaaagcuacug

SEQ ID NO: 7646 - RNA, 38 nt, Artificial Sequence
  Description of Artificial Sequence:  Enzymatic Nucleic Acid
  misc_feature (18)..(25): n stands for any nucleotide and can be optionally absent
gaguaugucugaugaggnnnnnnnnccgaaaagcuacu

SEQ ID NO: 7647 - RNA, 38 nt, Artificial Sequence
  Description of Artificial Sequence:  Enzymatic Nucleic Acid
  misc_feature (18)..(25): n stands for any nucleotide and can be optionally absent
gggucgagcugaugaggnnnnnnnnccgaaaugugaag

SEQ ID NO: 7648 - RNA, 38 nt, Artificial Sequence
  Description of Artificial Sequence:  Enzymatic Nucleic Acid
  misc_feature (18)..(25): n stands for any nucleotide and can be optionally absent
uggggguccugaugaggnnnnnnnnccgaaaguaugug

SEQ ID NO: 7649 - RNA, 38 nt, Artificial Sequence
  Description of Artificial Sequence:  Enzymatic Nucleic Acid
  misc_feature (18)..(25): n stands for any nucleotide and can be optionally absent
ccucagagcugaugaggnnnnnnnnccgaaaggugggg

SEQ ID NO: 7650 - RNA, 38 nt, Artificial Sequence
  Description of Artificial Sequence:  Enzymatic Nucleic Acid
  misc_feature (18)..(25): n stands for any nucleotide and can be optionally absent
uccucagacugaugaggnnnnnnnnccgaaaagguggg

SEQ ID NO: 7651 - RNA, 38 nt, Artificial Sequence
  Description of Artificial Sequence:  Enzymatic Nucleic Acid
  misc_feature (18)..(25): n stands for any nucleotide and can be optionally absent
gguccucacugaugaggnnnnnnnnccgaaagaaggug

SEQ ID NO: 7652 - RNA, 38 nt, Artificial Sequence
  Description of Artificial Sequence:  Enzymatic Nucleic Acid
  misc_feature (18)..(25): n stands for any nucleotide and can be optionally absent
uccuugaacugaugaggnnnnnnnnccgaaagguccuc

SEQ ID NO: 7653 - RNA, 38 nt, Artificial Sequence
  Description of Artificial Sequence:  Enzymatic Nucleic Acid
  misc_feature (18)..(25): n stands for any nucleotide and can be optionally absent
guccuugacugaugaggnnnnnnnnccgaaaagguccu

SEQ ID NO: 7654 - RNA, 38 nt, Artificial Sequence
  Description of Artificial Sequence:  Enzymatic Nucleic Acid
  misc_feature (18)..(25): n stands for any nucleotide and can be optionally absent
cguccuugcugaugaggnnnnnnnnccgaaaaaggucc

SEQ ID NO: 7655 - RNA, 38 nt, Artificial Sequence
  Description of Artificial Sequence:  Enzymatic Nucleic Acid
  misc_feature (18)..(25): n stands for any nucleotide and can be optionally absent
ccguccuucugaugaggnnnnnnnnccgaaaaaagguc

SEQ ID NO: 7656 - RNA, 38 nt, Artificial Sequence
  Description of Artificial Sequence:  Enzymatic Nucleic Acid
  misc_feature (18)..(25): n stands for any nucleotide and can be optionally absent
gaucugcacugaugaggnnnnnnnnccgaaagccgucc

SEQ ID NO: 7657 - RNA, 38 nt, Artificial Sequence
  Description of Artificial Sequence:  Enzymatic Nucleic Acid
  misc_feature (18)..(25): n stands for any nucleotide and can be optionally absent
ggaucugccugaugaggnnnnnnnnccgaaaagccguc

SEQ ID NO: 7658 - RNA, 38 nt, Artificial Sequence
  Description of Artificial Sequence:  Enzymatic Nucleic Acid
  misc_feature (18)..(25): n stands for any nucleotide and can be optionally absent
aaaaugugcugaugaggnnnnnnnnccgaaaucugcaa

SEQ ID NO: 7659 - RNA, 38 nt, Artificial Sequence
  Description of Artificial Sequence:  Enzymatic Nucleic Acid
  misc_feature (18)..(25): n stands for any nucleotide and can be optionally absent
ggaaugaacugaugaggnnnnnnnnccgaaauguggau

SEQ ID NO: 7660 - RNA, 38 nt, Artificial Sequence
  Description of Artificial Sequence:  Enzymatic Nucleic Acid
  misc_feature (18)..(25): n stands for any nucleotide and can be optionally absent
cggaaugacugaugaggnnnnnnnnccgaaaaugugga

SEQ ID NO: 7661 - RNA, 38 nt, Artificial Sequence
  Description of Artificial Sequence:  Enzymatic Nucleic Acid
  misc_feature (18)..(25): n stands for any nucleotide and can be optionally absent
ccggaaugcugaugaggnnnnnnnnccgaaaaaugugg

SEQ ID NO: 7662 - RNA, 38 nt, Artificial Sequence
  Description of Artificial Sequence:  Enzymatic Nucleic Acid
  misc_feature (18)..(25): n stands for any nucleotide and can be optionally absent
uccggaaucugaugaggnnnnnnnnccgaaaaaaugug

SEQ ID NO: 7663 - RNA, 38 nt, Artificial Sequence
  Description of Artificial Sequence:  Enzymatic Nucleic Acid
  misc_feature (18)..(25): n stands for any nucleotide and can be optionally absent
gcuuccggcugaugaggnnnnnnnnccgaaaugaaaau

SEQ ID NO: 7664 - RNA, 38 nt, Artificial Sequence
  Description of Artificial Sequence:  Enzymatic Nucleic Acid
  misc_feature (18)..(25): n stands for any nucleotide and can be optionally absent
agcuuccgcugaugaggnnnnnnnnccgaaaaugaaaa

SEQ ID NO: 7665 - RNA, 38 nt, Artificial Sequence
  Description of Artificial Sequence:  Enzymatic Nucleic Acid
  misc_feature (18)..(25): n stands for any nucleotide and can be optionally absent
caucaucacugaugaggnnnnnnnnccgaaagcuuccg

SEQ ID NO: 7666 - RNA, 38 nt, Artificial Sequence
  Description of Artificial Sequence:  Enzymatic Nucleic Acid
  misc_feature (18)..(25): n stands for any nucleotide and can be optionally absent
cguuuacacugaugaggnnnnnnnnccgaaaucucaca

SEQ ID NO: 7667 - RNA, 38 nt, Artificial Sequence
  Description of Artificial Sequence:  Enzymatic Nucleic Acid
  misc_feature (18)..(25): n stands for any nucleotide and can be optionally absent
aaagcguucugaugaggnnnnnnnnccgaaacauaucu

SEQ ID NO: 7668 - RNA, 38 nt, Artificial Sequence
  Description of Artificial Sequence:  Enzymatic Nucleic Acid
  misc_feature (18)..(25): n stands for any nucleotide and can be optionally absent
gaauuugacugaugaggnnnnnnnnccgaaagcguuua

SEQ ID NO: 7669 - RNA, 38 nt, Artificial Sequence
  Description of Artificial Sequence:  Enzymatic Nucleic Acid
  misc_feature (18)..(25): n stands for any nucleotide and can be optionally absent
ugaauuugcugaugaggnnnnnnnnccgaaaagcguuu

SEQ ID NO: 7670 - RNA, 38 nt, Artificial Sequence
  Description of Artificial Sequence:  Enzymatic Nucleic Acid
  misc_feature (18)..(25): n stands for any nucleotide and can be optionally absent
augaauuucugaugaggnnnnnnnnccgaaaaagcguu

SEQ ID NO: 7671 - RNA, 38 nt, Artificial Sequence
  Description of Artificial Sequence:  Enzymatic Nucleic Acid
  misc_feature (18)..(25): n stands for any nucleotide and can be optionally absent
ggcucaugcugaugaggnnnnnnnnccgaaauuugaaa

SEQ ID NO: 7672 - RNA, 38 nt, Artificial Sequence
  Description of Artificial Sequence:  Enzymatic Nucleic Acid
  misc_feature (18)..(25): n stands for any nucleotide and can be optionally absent
aggcucaucugaugaggnnnnnnnnccgaaaauuugaa

SEQ ID NO: 7673 - RNA, 38 nt, Artificial Sequence
  Description of Artificial Sequence:  Enzymatic Nucleic Acid
  misc_feature (18)..(25): n stands for any nucleotide and can be optionally absent
gcuccucacugaugaggnnnnnnnnccgaaagguuuug

SEQ ID NO: 7674 - RNA, 38 nt, Artificial Sequence
  Description of Artificial Sequence:  Enzymatic Nucleic Acid
  misc_feature (18)..(25): n stands for any nucleotide and can be optionally absent
agcuccuccugaugaggnnnnnnnnccgaaaagguuuu

SEQ ID NO: 7675 - RNA, 38 nt, Artificial Sequence
  Description of Artificial Sequence:  Enzymatic Nucleic Acid
  misc_feature (18)..(25): n stands for any nucleotide and can be optionally absent
uucggugacugaugaggnnnnnnnnccgaaagcuccuc

SEQ ID NO: 7676 - RNA, 38 nt, Artificial Sequence
  Description of Artificial Sequence:  Enzymatic Nucleic Acid
  misc_feature (18)..(25): n stands for any nucleotide and can be optionally absent
guucggugcugaugaggnnnnnnnnccgaaaagcuccu

SEQ ID NO: 7677 - RNA, 38 nt, Artificial Sequence
  Description of Artificial Sequence:  Enzymatic Nucleic Acid
  misc_feature (18)..(25): n stands for any nucleotide and can be optionally absent
aguucggucugaugaggnnnnnnnnccgaaaaagcucc

SEQ ID NO: 7678 - RNA, 38 nt, Artificial Sequence
  Description of Artificial Sequence:  Enzymatic Nucleic Acid
  misc_feature (18)..(25): n stands for any nucleotide and can be optionally absent
uggaggugcugaugaggnnnnnnnnccgaaaguucggu

SEQ ID NO: 7679 - RNA, 38 nt, Artificial Sequence
  Description of Artificial Sequence:  Enzymatic Nucleic Acid
  misc_feature (18)..(25): n stands for any nucleotide and can be optionally absent
caaacaugcugaugaggnnnnnnnnccgaaagguggag

SEQ ID NO: 7680 - RNA, 38 nt, Artificial Sequence
  Description of Artificial Sequence:  Enzymatic Nucleic Acid
  misc_feature (18)..(25): n stands for any nucleotide and can be optionally absent
aguccucacugaugaggnnnnnnnnccgaaacauggag

SEQ ID NO: 7681 - RNA, 38 nt, Artificial Sequence
  Description of Artificial Sequence:  Enzymatic Nucleic Acid
  misc_feature (18)..(25): n stands for any nucleotide and can be optionally absent
uaguccuccugaugaggnnnnnnnnccgaaaacaugga

SEQ ID NO: 7682 - RNA, 38 nt, Artificial Sequence
  Description of Artificial Sequence:  Enzymatic Nucleic Acid
  misc_feature (18)..(25): n stands for any nucleotide and can be optionally absent
ccagcugacugaugaggnnnnnnnnccgaaaguccuca

SEQ ID NO: 7683 - RNA, 38 nt, Artificial Sequence
  Description of Artificial Sequence:  Enzymatic Nucleic Acid
  misc_feature (18)..(25): n stands for any nucleotide and can be optionally absent
guccagcucugaugaggnnnnnnnnccgaaauaguccu

SEQ ID NO: 7684 - RNA, 38 nt, Artificial Sequence
  Description of Artificial Sequence:  Enzymatic Nucleic Acid
  misc_feature (18)..(25): n stands for any nucleotide and can be optionally absent
cagagugccugaugaggnnnnnnnnccgaaagugucca

SEQ ID NO: 7685 - RNA, 38 nt, Artificial Sequence
  Description of Artificial Sequence:  Enzymatic Nucleic Acid
  misc_feature (18)..(25): n stands for any nucleotide and can be optionally absent
gcccagcacugaugaggnnnnnnnnccgaaagugcuag

SEQ ID NO: 7686 - RNA, 38 nt, Artificial Sequence
  Description of Artificial Sequence:  Enzymatic Nucleic Acid
  misc_feature (18)..(25): n stands for any nucleotide and can be optionally absent
gcaaggggcugaugaggnnnnnnnnccgaaagcccagc

SEQ ID NO: 7687 - RNA, 38 nt, Artificial Sequence
  Description of Artificial Sequence:  Enzymatic Nucleic Acid
  misc_feature (18)..(25): n stands for any nucleotide and can be optionally absent
gcuucagccugaugaggnnnnnnnnccgaaagggggag

SEQ ID NO: 7688 - RNA, 38 nt, Artificial Sequence
  Description of Artificial Sequence:  Enzymatic Nucleic Acid
  misc_feature (18)..(25): n stands for any nucleotide and can be optionally absent
uccaggugcugaugaggnnnnnnnnccgaaaccgcuuc

SEQ ID NO: 7689 - RNA, 38 nt, Artificial Sequence
  Description of Artificial Sequence:  Enzymatic Nucleic Acid
  misc_feature (18)..(25): n stands for any nucleotide and can be optionally absent
guccaggucugaugaggnnnnnnnnccgaaaaccgcuu

SEQ ID NO: 7690 - RNA, 38 nt, Artificial Sequence
  Description of Artificial Sequence:  Enzymatic Nucleic Acid
  misc_feature (18)..(25): n stands for any nucleotide and can be optionally absent
ucuucaugcugaugaggnnnnnnnnccgaaaggccuug

SEQ ID NO: 7691 - RNA, 38 nt, Artificial Sequence
  Description of Artificial Sequence:  Enzymatic Nucleic Acid
  misc_feature (18)..(25): n stands for any nucleotide and can be optionally absent
cucaaguccugaugaggnnnnnnnnccgaaaucuucau

SEQ ID NO: 7692 - RNA, 38 nt, Artificial Sequence
  Description of Artificial Sequence:  Enzymatic Nucleic Acid
  misc_feature (18)..(25): n stands for any nucleotide and can be optionally absent
cuauucuccugaugaggnnnnnnnnccgaaagucuauc

SEQ ID NO: 7693 - RNA, 38 nt, Artificial Sequence
  Description of Artificial Sequence:  Enzymatic Nucleic Acid
  misc_feature (18)..(25): n stands for any nucleotide and can be optionally absent
uuacucgccugaugaggnnnnnnnnccgaaauucucaa

SEQ ID NO: 7694 - RNA, 38 nt, Artificial Sequence
  Description of Artificial Sequence:  Enzymatic Nucleic Acid
  misc_feature (18)..(25): n stands for any nucleotide and can be optionally absent
cuugcuuucugaugaggnnnnnnnnccgaaacucgcua

SEQ ID NO: 7695 - RNA, 38 nt, Artificial Sequence
  Description of Artificial Sequence:  Enzymatic Nucleic Acid
  misc_feature (18)..(25): n stands for any nucleotide and can be optionally absent
agaucggacugaugaggnnnnnnnnccgaaagucccgc

SEQ ID NO: 7696 - RNA, 38 nt, Artificial Sequence
  Description of Artificial Sequence:  Enzymatic Nucleic Acid
  misc_feature (18)..(25): n stands for any nucleotide and can be optionally absent
cagaucggcugaugaggnnnnnnnnccgaaaagucccg

SEQ ID NO: 7697 - RNA, 38 nt, Artificial Sequence
  Description of Artificial Sequence:  Enzymatic Nucleic Acid
  misc_feature (18)..(25): n stands for any nucleotide and can be optionally absent
gcagaucgcugaugaggnnnnnnnnccgaaaaaguccc

SEQ ID NO: 7698 - RNA, 38 nt, Artificial Sequence
  Description of Artificial Sequence:  Enzymatic Nucleic Acid
  misc_feature (18)..(25): n stands for any nucleotide and can be optionally absent
ccucggcacugaugaggnnnnnnnnccgaaaucggaaa

SEQ ID NO: 7699 - RNA, 38 nt, Artificial Sequence
  Description of Artificial Sequence:  Enzymatic Nucleic Acid
  misc_feature (18)..(25): n stands for any nucleotide and can be optionally absent
agaagcagcugaugaggnnnnnnnnccgaaagcugggc

SEQ ID NO: 7700 - RNA, 38 nt, Artificial Sequence
  Description of Artificial Sequence:  Enzymatic Nucleic Acid
  misc_feature (18)..(25): n stands for any nucleotide and can be optionally absent
gagaagcacugaugaggnnnnnnnnccgaaaagcuggg

SEQ ID NO: 7701 - RNA, 38 nt, Artificial Sequence
  Description of Artificial Sequence:  Enzymatic Nucleic Acid
  misc_feature (18)..(25): n stands for any nucleotide and can be optionally absent
agcuggagcugaugaggnnnnnnnnccgaaagcagaag

SEQ ID NO: 7702 - RNA, 38 nt, Artificial Sequence
  Description of Artificial Sequence:  Enzymatic Nucleic Acid
  misc_feature (18)..(25): n stands for any nucleotide and can be optionally absent
cagcuggacugaugaggnnnnnnnnccgaaaagcagaa

SEQ ID NO: 7703 - RNA, 38 nt, Artificial Sequence
  Description of Artificial Sequence:  Enzymatic Nucleic Acid
  misc_feature (18)..(25): n stands for any nucleotide and can be optionally absent
cacagcugcugaugaggnnnnnnnnccgaaagaagcag

SEQ ID NO: 7704 - RNA, 38 nt, Artificial Sequence
  Description of Artificial Sequence:  Enzymatic Nucleic Acid
  misc_feature (18)..(25): n stands for any nucleotide and can be optionally absent
acgggccucugaugaggnnnnnnnnccgaaauguggcc

SEQ ID NO: 7705 - RNA, 38 nt, Artificial Sequence
  Description of Artificial Sequence:  Enzymatic Nucleic Acid
  misc_feature (18)..(25): n stands for any nucleotide and can be optionally absent
ccagcucacugaugaggnnnnnnnnccgaaauucaucg

SEQ ID NO: 7706 - RNA, 38 nt, Artificial Sequence
  Description of Artificial Sequence:  Enzymatic Nucleic Acid
  misc_feature (18)..(25): n stands for any nucleotide and can be optionally absent
aacagcagcugaugaggnnnnnnnnccgaaacuccuuu

SEQ ID NO: 7707 - RNA, 38 nt, Artificial Sequence
  Description of Artificial Sequence:  Enzymatic Nucleic Acid
  misc_feature (18)..(25): n stands for any nucleotide and can be optionally absent
ggguggagcugaugaggnnnnnnnnccgaaacagcagg

SEQ ID NO: 7708 - RNA, 38 nt, Artificial Sequence
  Description of Artificial Sequence:  Enzymatic Nucleic Acid
  misc_feature (18)..(25): n stands for any nucleotide and can be optionally absent
gggguggacugaugaggnnnnnnnnccgaaaacagcag

SEQ ID NO: 7709 - RNA, 38 nt, Artificial Sequence
  Description of Artificial Sequence:  Enzymatic Nucleic Acid
  misc_feature (18)..(25): n stands for any nucleotide and can be optionally absent
ugggggugcugaugaggnnnnnnnnccgaaagaacagc

SEQ ID NO: 7710 - RNA, 38 nt, Artificial Sequence
  Description of Artificial Sequence:  Enzymatic Nucleic Acid
  misc_feature (18)..(25): n stands for any nucleotide and can be optionally absent
cggaguugcugaugaggnnnnnnnnccgaaagucuggg

SEQ ID NO: 7711 - RNA, 38 nt, Artificial Sequence
  Description of Artificial Sequence:  Enzymatic Nucleic Acid
  misc_feature (18)..(25): n stands for any nucleotide and can be optionally absent
acaccacgcugaugaggnnnnnnnnccgaaaguuguag

SEQ ID NO: 7712 - RNA, 38 nt, Artificial Sequence
  Description of Artificial Sequence:  Enzymatic Nucleic Acid
  misc_feature (18)..(25): n stands for any nucleotide and can be optionally absent
aggaguaccugaugaggnnnnnnnnccgaaacaccacg

SEQ ID NO: 7713 - RNA, 38 nt, Artificial Sequence
  Description of Artificial Sequence:  Enzymatic Nucleic Acid
  misc_feature (18)..(25): n stands for any nucleotide and can be optionally absent
gggaggagcugaugaggnnnnnnnnccgaaacaacacc

SEQ ID NO: 7714 - RNA, 38 nt, Artificial Sequence
  Description of Artificial Sequence:  Enzymatic Nucleic Acid
  misc_feature (18)..(25): n stands for any nucleotide and can be optionally absent
gcggggagcugaugaggnnnnnnnnccgaaaguacaac

SEQ ID NO: 7715 - RNA, 38 nt, Artificial Sequence
  Description of Artificial Sequence:  Enzymatic Nucleic Acid
  misc_feature (18)..(25): n stands for any nucleotide and can be optionally absent
cgggcgggcugaugaggnnnnnnnnccgaaaggaguac

SEQ ID NO: 7716 - RNA, 38 nt, Artificial Sequence
  Description of Artificial Sequence:  Enzymatic Nucleic Acid
  misc_feature (18)..(25): n stands for any nucleotide and can be optionally absent
agaagcuucugaugaggnnnnnnnnccgaaaggcgggc

SEQ ID NO: 7717 - RNA, 38 nt, Artificial Sequence
  Description of Artificial Sequence:  Enzymatic Nucleic Acid
  misc_feature (18)..(25): n stands for any nucleotide and can be optionally absent
cuggugagcugaugaggnnnnnnnnccgaaagcuuuag

SEQ ID NO: 7718 - RNA, 38 nt, Artificial Sequence
  Description of Artificial Sequence:  Enzymatic Nucleic Acid
  misc_feature (18)..(25): n stands for any nucleotide and can be optionally absent
gcuggugacugaugaggnnnnnnnnccgaaaagcuuua

SEQ ID NO: 7719 - RNA, 38 nt, Artificial Sequence
  Description of Artificial Sequence:  Enzymatic Nucleic Acid
  misc_feature (18)..(25): n stands for any nucleotide and can be optionally absent
gggcuggucugaugaggnnnnnnnnccgaaagaagcuu

SEQ ID NO: 7720 - RNA, 38 nt, Artificial Sequence
  Description of Artificial Sequence:  Enzymatic Nucleic Acid
  misc_feature (18)..(25): n stands for any nucleotide and can be optionally absent
auguauaacugaugaggnnnnnnnnccgaaacugucag

SEQ ID NO: 7721 - RNA, 38 nt, Artificial Sequence
  Description of Artificial Sequence:  Enzymatic Nucleic Acid
  misc_feature (18)..(25): n stands for any nucleotide and can be optionally absent
agauguaucugaugaggnnnnnnnnccgaaauacuguc

SEQ ID NO: 7722 - RNA, 38 nt, Artificial Sequence
  Description of Artificial Sequence:  Enzymatic Nucleic Acid
  misc_feature (18)..(25): n stands for any nucleotide and can be optionally absent
uagauguacugaugaggnnnnnnnnccgaaaauacugu

SEQ ID NO: 7723 - RNA, 38 nt, Artificial Sequence
  Description of Artificial Sequence:  Enzymatic Nucleic Acid
  misc_feature (18)..(25): n stands for any nucleotide and can be optionally absent
cauagaugcugaugaggnnnnnnnnccgaaauaauacu

SEQ ID NO: 7724 - RNA, 38 nt, Artificial Sequence
  Description of Artificial Sequence:  Enzymatic Nucleic Acid
  misc_feature (18)..(25): n stands for any nucleotide and can be optionally absent
aacucauacugaugaggnnnnnnnnccgaaauguauaa

SEQ ID NO: 7725 - RNA, 38 nt, Artificial Sequence
  Description of Artificial Sequence:  Enzymatic Nucleic Acid
  misc_feature (18)..(25): n stands for any nucleotide and can be optionally absent
uaaacucacugaugaggnnnnnnnnccgaaagauguau

SEQ ID NO: 7726 - RNA, 38 nt, Artificial Sequence
  Description of Artificial Sequence:  Enzymatic Nucleic Acid
  misc_feature (18)..(25): n stands for any nucleotide and can be optionally absent
uagguguacugaugaggnnnnnnnnccgaaacucauag

SEQ ID NO: 7727 - RNA, 38 nt, Artificial Sequence
  Description of Artificial Sequence:  Enzymatic Nucleic Acid
  misc_feature (18)..(25): n stands for any nucleotide and can be optionally absent
auaggugucugaugaggnnnnnnnnccgaaaacucaua

SEQ ID NO: 7728 - RNA, 38 nt, Artificial Sequence
  Description of Artificial Sequence:  Enzymatic Nucleic Acid
  misc_feature (18)..(25): n stands for any nucleotide and can be optionally absent
aauaggugcugaugaggnnnnnnnnccgaaaaacucau

SEQ ID NO: 7729 - RNA, 38 nt, Artificial Sequence
  Description of Artificial Sequence:  Enzymatic Nucleic Acid
  misc_feature (18)..(25): n stands for any nucleotide and can be optionally absent
gagcggaacugaugaggnnnnnnnnccgaaagguguaa

SEQ ID NO: 7730 - RNA, 38 nt, Artificial Sequence
  Description of Artificial Sequence:  Enzymatic Nucleic Acid
  misc_feature (18)..(25): n stands for any nucleotide and can be optionally absent
uggagcggcugaugaggnnnnnnnnccgaaauaggugu

SEQ ID NO: 7731 - RNA, 38 nt, Artificial Sequence
  Description of Artificial Sequence:  Enzymatic Nucleic Acid
  misc_feature (18)..(25): n stands for any nucleotide and can be optionally absent
guggagcgcugaugaggnnnnnnnnccgaaaauaggug

SEQ ID NO: 7732 - RNA, 38 nt, Artificial Sequence
  Description of Artificial Sequence:  Enzymatic Nucleic Acid
  misc_feature (18)..(25): n stands for any nucleotide and can be optionally absent
cuccugugcugaugaggnnnnnnnnccgaaagcggaau

SEQ ID NO: 7733 - RNA, 38 nt, Artificial Sequence
  Description of Artificial Sequence:  Enzymatic Nucleic Acid
  misc_feature (18)..(25): n stands for any nucleotide and can be optionally absent
gucacgaacugaugaggnnnnnnnnccgaaagcagcug

SEQ ID NO: 7734 - RNA, 38 nt, Artificial Sequence
  Description of Artificial Sequence:  Enzymatic Nucleic Acid
  misc_feature (18)..(25): n stands for any nucleotide and can be optionally absent
ggucacgacugaugaggnnnnnnnnccgaaaagcagcu

SEQ ID NO: 7735 - RNA, 38 nt, Artificial Sequence
  Description of Artificial Sequence:  Enzymatic Nucleic Acid
  misc_feature (18)..(25): n stands for any nucleotide and can be optionally absent
aggucacgcugaugaggnnnnnnnnccgaaaaagcagc

SEQ ID NO: 7736 - RNA, 38 nt, Artificial Sequence
  Description of Artificial Sequence:  Enzymatic Nucleic Acid
  misc_feature (18)..(25): n stands for any nucleotide and can be optionally absent
aaggucaccugaugaggnnnnnnnnccgaaaaaagcag

SEQ ID NO: 7737 - RNA, 38 nt, Artificial Sequence
  Description of Artificial Sequence:  Enzymatic Nucleic Acid
  misc_feature (18)..(25): n stands for any nucleotide and can be optionally absent
cacgauuacugaugaggnnnnnnnnccgaaaggucacg

SEQ ID NO: 7738 - RNA, 38 nt, Artificial Sequence
  Description of Artificial Sequence:  Enzymatic Nucleic Acid
  misc_feature (18)..(25): n stands for any nucleotide and can be optionally absent
gcacgauucugaugaggnnnnnnnnccgaaaaggucac

SEQ ID NO: 7739 - RNA, 38 nt, Artificial Sequence
  Description of Artificial Sequence:  Enzymatic Nucleic Acid
  misc_feature (18)..(25): n stands for any nucleotide and can be optionally absent
agcacgaucugaugaggnnnnnnnnccgaaaaagguca

SEQ ID NO: 7740 - RNA, 38 nt, Artificial Sequence
  Description of Artificial Sequence:  Enzymatic Nucleic Acid
  misc_feature (18)..(25): n stands for any nucleotide and can be optionally absent
aaaagcaccugaugaggnnnnnnnnccgaaauuaaagg

SEQ ID NO: 7741 - RNA, 38 nt, Artificial Sequence
  Description of Artificial Sequence:  Enzymatic Nucleic Acid
  misc_feature (18)..(25): n stands for any nucleotide and can be optionally absent
aaacaaaacugaugaggnnnnnnnnccgaaagcacgau

SEQ ID NO: 7742 - RNA, 38 nt, Artificial Sequence
  Description of Artificial Sequence:  Enzymatic Nucleic Acid
  misc_feature (18)..(25): n stands for any nucleotide and can be optionally absent
aaaacaaacugaugaggnnnnnnnnccgaaaagcacga

SEQ ID NO: 7743 - RNA, 38 nt, Artificial Sequence
  Description of Artificial Sequence:  Enzymatic Nucleic Acid
  misc_feature (18)..(25): n stands for any nucleotide and can be optionally absent
aaaaacaacugaugaggnnnnnnnnccgaaaaagcacg

SEQ ID NO: 7744 - RNA, 38 nt, Artificial Sequence
  Description of Artificial Sequence:  Enzymatic Nucleic Acid
  misc_feature (18)..(25): n stands for any nucleotide and can be optionally absent
aaaaaacacugaugaggnnnnnnnnccgaaaaaagcac

SEQ ID NO: 7745 - RNA, 38 nt, Artificial Sequence
  Description of Artificial Sequence:  Enzymatic Nucleic Acid
  misc_feature (18)..(25): n stands for any nucleotide and can be optionally absent
caaaaaaccugaugaggnnnnnnnnccgaaaaaaagca

SEQ ID NO: 7746 - RNA, 38 nt, Artificial Sequence
  Description of Artificial Sequence:  Enzymatic Nucleic Acid
  misc_feature (18)..(25): n stands for any nucleotide and can be optionally absent
aaacaaaacugaugaggnnnnnnnnccgaaacaaaaaa

SEQ ID NO: 7747 - RNA, 38 nt, Artificial Sequence
  Description of Artificial Sequence:  Enzymatic Nucleic Acid
  misc_feature (18)..(25): n stands for any nucleotide and can be optionally absent
aaaacaaacugaugaggnnnnnnnnccgaaaacaaaaa

SEQ ID NO: 7748 - RNA, 38 nt, Artificial Sequence
  Description of Artificial Sequence:  Enzymatic Nucleic Acid
  misc_feature (18)..(25): n stands for any nucleotide and can be optionally absent
caaaacaacugaugaggnnnnnnnnccgaaaaacaaaa

SEQ ID NO: 7749 - RNA, 38 nt, Artificial Sequence
  Description of Artificial Sequence:  Enzymatic Nucleic Acid
  misc_feature (18)..(25): n stands for any nucleotide and can be optionally absent
acaaaacacugaugaggnnnnnnnnccgaaaaaacaaa

SEQ ID NO: 7750 - RNA, 38 nt, Artificial Sequence
  Description of Artificial Sequence:  Enzymatic Nucleic Acid
  misc_feature (18)..(25): n stands for any nucleotide and can be optionally absent
aacaaaaccugaugaggnnnnnnnnccgaaaaaaacaa

SEQ ID NO: 7751 - RNA, 38 nt, Artificial Sequence
  Description of Artificial Sequence:  Enzymatic Nucleic Acid
  misc_feature (18)..(25): n stands for any nucleotide and can be optionally absent
acaaacaacugaugaggnnnnnnnnccgaaacaaaaaa

SEQ ID NO: 7752 - RNA, 38 nt, Artificial Sequence
  Description of Artificial Sequence:  Enzymatic Nucleic Acid
  misc_feature (18)..(25): n stands for any nucleotide and can be optionally absent
aacaaacacugaugaggnnnnnnnnccgaaaacaaaaa

SEQ ID NO: 7753 - RNA, 38 nt, Artificial Sequence
  Description of Artificial Sequence:  Enzymatic Nucleic Acid
  misc_feature (18)..(25): n stands for any nucleotide and can be optionally absent
caacaaaccugaugaggnnnnnnnnccgaaaaacaaaa

SEQ ID NO: 7754 - RNA, 38 nt, Artificial Sequence
  Description of Artificial Sequence:  Enzymatic Nucleic Acid
  misc_feature (18)..(25): n stands for any nucleotide and can be optionally absent
caacaacacugaugaggnnnnnnnnccgaaacaaaaca

SEQ ID NO: 7755 - RNA, 38 nt, Artificial Sequence
  Description of Artificial Sequence:  Enzymatic Nucleic Acid
  misc_feature (18)..(25): n stands for any nucleotide and can be optionally absent
gcaacaaccugaugaggnnnnnnnnccgaaaacaaaac

SEQ ID NO: 7756 - RNA, 38 nt, Artificial Sequence
  Description of Artificial Sequence:  Enzymatic Nucleic Acid
  misc_feature (18)..(25): n stands for any nucleotide and can be optionally absent
acagcaaccugaugaggnnnnnnnnccgaaacaaacaa

SEQ ID NO: 7757 - RNA, 38 nt, Artificial Sequence
  Description of Artificial Sequence:  Enzymatic Nucleic Acid
  misc_feature (18)..(25): n stands for any nucleotide and can be optionally absent
aaaacagccugaugaggnnnnnnnnccgaaacaacaaa

SEQ ID NO: 7758 - RNA, 38 nt, Artificial Sequence
  Description of Artificial Sequence:  Enzymatic Nucleic Acid
  misc_feature (18)..(25): n stands for any nucleotide and can be optionally absent
uuagucaacugaugaggnnnnnnnnccgaaacagcaac

SEQ ID NO: 7759 - RNA, 38 nt, Artificial Sequence
  Description of Artificial Sequence:  Enzymatic Nucleic Acid
  misc_feature (18)..(25): n stands for any nucleotide and can be optionally absent
guuagucacugaugaggnnnnnnnnccgaaaacagcaa

SEQ ID NO: 7760 - RNA, 38 nt, Artificial Sequence
  Description of Artificial Sequence:  Enzymatic Nucleic Acid
  misc_feature (18)..(25): n stands for any nucleotide and can be optionally absent
uguuaguccugaugaggnnnnnnnnccgaaaaacagca

SEQ ID NO: 7761 - RNA, 38 nt, Artificial Sequence
  Description of Artificial Sequence:  Enzymatic Nucleic Acid
  misc_feature (18)..(25): n stands for any nucleotide and can be optionally absent
acuggggucugaugaggnnnnnnnnccgaaacauucuu

SEQ ID NO: 7762 - RNA, 38 nt, Artificial Sequence
  Description of Artificial Sequence:  Enzymatic Nucleic Acid
  misc_feature (18)..(25): n stands for any nucleotide and can be optionally absent
acgucacucugaugaggnnnnnnnnccgaaacuggggu

SEQ ID NO: 7763 - RNA, 38 nt, Artificial Sequence
  Description of Artificial Sequence:  Enzymatic Nucleic Acid
  misc_feature (18)..(25): n stands for any nucleotide and can be optionally absent
cacgucaccugaugaggnnnnnnnnccgaaaacugggg

SEQ ID NO: 7764 - RNA, 38 nt, Artificial Sequence
  Description of Artificial Sequence:  Enzymatic Nucleic Acid
  misc_feature (18)..(25): n stands for any nucleotide and can be optionally absent
aacaauagcugaugaggnnnnnnnnccgaaauucuuca

SEQ ID NO: 7765 - RNA, 38 nt, Artificial Sequence
  Description of Artificial Sequence:  Enzymatic Nucleic Acid
  misc_feature (18)..(25): n stands for any nucleotide and can be optionally absent
ucuaacaacugaugaggnnnnnnnnccgaaaguauucu

SEQ ID NO: 7766 - RNA, 38 nt, Artificial Sequence
  Description of Artificial Sequence:  Enzymatic Nucleic Acid
  misc_feature (18)..(25): n stands for any nucleotide and can be optionally absent
ucucuaaccugaugaggnnnnnnnnccgaaauaguauu

SEQ ID NO: 7767 - RNA, 38 nt, Artificial Sequence
  Description of Artificial Sequence:  Enzymatic Nucleic Acid
  misc_feature (18)..(25): n stands for any nucleotide and can be optionally absent
auuucucucugaugaggnnnnnnnnccgaaacaauagu

SEQ ID NO: 7768 - RNA, 38 nt, Artificial Sequence
  Description of Artificial Sequence:  Enzymatic Nucleic Acid
  misc_feature (18)..(25): n stands for any nucleotide and can be optionally absent
gauuucuccugaugaggnnnnnnnnccgaaaacaauag

SEQ ID NO: 7769 - RNA, 38 nt, Artificial Sequence
  Description of Artificial Sequence:  Enzymatic Nucleic Acid
  misc_feature (18)..(25): n stands for any nucleotide and can be optionally absent
gcggggggcugaugaggnnnnnnnnccgaaauuucucu

SEQ ID NO: 7770 - RNA, 38 nt, Artificial Sequence
  Description of Artificial Sequence:  Enzymatic Nucleic Acid
  misc_feature (18)..(25): n stands for any nucleotide and can be optionally absent
guuacccucugaugaggnnnnnnnnccgaaaggcuuug

SEQ ID NO: 7771 - RNA, 38 nt, Artificial Sequence
  Description of Artificial Sequence:  Enzymatic Nucleic Acid
  misc_feature (18)..(25): n stands for any nucleotide and can be optionally absent
guccaggucugaugaggnnnnnnnnccgaaacccugag

SEQ ID NO: 7772 - RNA, 38 nt, Artificial Sequence
  Description of Artificial Sequence:  Enzymatic Nucleic Acid
  misc_feature (18)..(25): n stands for any nucleotide and can be optionally absent
ggucgccacugaugaggnnnnnnnnccgaaaggcaccu

SEQ ID NO: 7773 - RNA, 38 nt, Artificial Sequence
  Description of Artificial Sequence:  Enzymatic Nucleic Acid
  misc_feature (18)..(25): n stands for any nucleotide and can be optionally absent
gcugcaggcugaugaggnnnnnnnnccgaaaggguggg

SEQ ID NO: 7774 - RNA, 38 nt, Artificial Sequence
  Description of Artificial Sequence:  Enzymatic Nucleic Acid
  misc_feature (18)..(25): n stands for any nucleotide and can be optionally absent
acugccuccugaugaggnnnnnnnnccgaaagucccac

SEQ ID NO: 7775 - RNA, 38 nt, Artificial Sequence
  Description of Artificial Sequence:  Enzymatic Nucleic Acid
  misc_feature (18)..(25): n stands for any nucleotide and can be optionally absent
aaugggcucugaugaggnnnnnnnnccgaaacugccuc

SEQ ID NO: 7776 - RNA, 38 nt, Artificial Sequence
  Description of Artificial Sequence:  Enzymatic Nucleic Acid
  misc_feature (18)..(25): n stands for any nucleotide and can be optionally absent
caugagcucugaugaggnnnnnnnnccgaaaugggcuu

SEQ ID NO: 7777 - RNA, 38 nt, Artificial Sequence
  Description of Artificial Sequence:  Enzymatic Nucleic Acid
  misc_feature (18)..(25): n stands for any nucleotide and can be optionally absent
ccaugagccugaugaggnnnnnnnnccgaaaaugggcu

SEQ ID NO: 7778 - RNA, 38 nt, Artificial Sequence
  Description of Artificial Sequence:  Enzymatic Nucleic Acid
  misc_feature (18)..(25): n stands for any nucleotide and can be optionally absent
gcagccaucugaugaggnnnnnnnnccgaaagcuaaug

SEQ ID NO: 7779 - RNA, 38 nt, Artificial Sequence
  Description of Artificial Sequence:  Enzymatic Nucleic Acid
  misc_feature (18)..(25): n stands for any nucleotide and can be optionally absent
gagagacacugaugaggnnnnnnnnccgaaagcagguc

SEQ ID NO: 7780 - RNA, 38 nt, Artificial Sequence
  Description of Artificial Sequence:  Enzymatic Nucleic Acid
  misc_feature (18)..(25): n stands for any nucleotide and can be optionally absent
auaagagacugaugaggnnnnnnnnccgaaacagagca

SEQ ID NO: 7781 - RNA, 38 nt, Artificial Sequence
  Description of Artificial Sequence:  Enzymatic Nucleic Acid
  misc_feature (18)..(25): n stands for any nucleotide and can be optionally absent
ccauaagacugaugaggnnnnnnnnccgaaagacagag

SEQ ID NO: 7782 - RNA, 38 nt, Artificial Sequence
  Description of Artificial Sequence:  Enzymatic Nucleic Acid
  misc_feature (18)..(25): n stands for any nucleotide and can be optionally absent
cuccauaacugaugaggnnnnnnnnccgaaagagacag

SEQ ID NO: 7783 - RNA, 38 nt, Artificial Sequence
  Description of Artificial Sequence:  Enzymatic Nucleic Acid
  misc_feature (18)..(25): n stands for any nucleotide and can be optionally absent
uccuccaucugaugaggnnnnnnnnccgaaagagagac

SEQ ID NO: 7784 - RNA, 38 nt, Artificial Sequence
  Description of Artificial Sequence:  Enzymatic Nucleic Acid
  misc_feature (18)..(25): n stands for any nucleotide and can be optionally absent
uuccuccacugaugaggnnnnnnnnccgaaaagagaga

SEQ ID NO: 7785 - RNA, 38 nt, Artificial Sequence
  Description of Artificial Sequence:  Enzymatic Nucleic Acid
  misc_feature (18)..(25): n stands for any nucleotide and can be optionally absent
gcaucccacugaugaggnnnnnnnnccgaaagccuuuu

SEQ ID NO: 7786 - RNA, 38 nt, Artificial Sequence
  Description of Artificial Sequence:  Enzymatic Nucleic Acid
  misc_feature (18)..(25): n stands for any nucleotide and can be optionally absent
cgcauccccugaugaggnnnnnnnnccgaaaagccuuu

SEQ ID NO: 7787 - RNA, 38 nt, Artificial Sequence
  Description of Artificial Sequence:  Enzymatic Nucleic Acid
  misc_feature (18)..(25): n stands for any nucleotide and can be optionally absent
acaggacgcugaugaggnnnnnnnnccgaaacgcaucc

SEQ ID NO: 7788 - RNA, 38 nt, Artificial Sequence
  Description of Artificial Sequence:  Enzymatic Nucleic Acid
  misc_feature (18)..(25): n stands for any nucleotide and can be optionally absent
cuccacagcugaugaggnnnnnnnnccgaaacggacgc

SEQ ID NO: 7789 - RNA, 38 nt, Artificial Sequence
  Description of Artificial Sequence:  Enzymatic Nucleic Acid
  misc_feature (18)..(25): n stands for any nucleotide and can be optionally absent
gcauagcgcugaugaggnnnnnnnnccgaaagcccccu

SEQ ID NO: 7790 - RNA, 38 nt, Artificial Sequence
  Description of Artificial Sequence:  Enzymatic Nucleic Acid
  misc_feature (18)..(25): n stands for any nucleotide and can be optionally absent
aaguggcacugaugaggnnnnnnnnccgaaagcggagc

SEQ ID NO: 7791 - RNA, 38 nt, Artificial Sequence
  Description of Artificial Sequence:  Enzymatic Nucleic Acid
  misc_feature (18)..(25): n stands for any nucleotide and can be optionally absent
agucacugcugaugaggnnnnnnnnccgaaaguggcau

SEQ ID NO: 7792 - RNA, 38 nt, Artificial Sequence
  Description of Artificial Sequence:  Enzymatic Nucleic Acid
  misc_feature (18)..(25): n stands for any nucleotide and can be optionally absent
aagucacucugaugaggnnnnnnnnccgaaaaguggca

SEQ ID NO: 7793 - RNA, 38 nt, Artificial Sequence
  Description of Artificial Sequence:  Enzymatic Nucleic Acid
  misc_feature (18)..(25): n stands for any nucleotide and can be optionally absent
ggagugagcugaugaggnnnnnnnnccgaaagucacug

SEQ ID NO: 7794 - RNA, 38 nt, Artificial Sequence
  Description of Artificial Sequence:  Enzymatic Nucleic Acid
  misc_feature (18)..(25): n stands for any nucleotide and can be optionally absent
aggagugacugaugaggnnnnnnnnccgaaaagucacu

SEQ ID NO: 7795 - RNA, 38 nt, Artificial Sequence
  Description of Artificial Sequence:  Enzymatic Nucleic Acid
  misc_feature (18)..(25): n stands for any nucleotide and can be optionally absent
ccaggagucugaugaggnnnnnnnnccgaaagaaguca

SEQ ID NO: 7796 - RNA, 38 nt, Artificial Sequence
  Description of Artificial Sequence:  Enzymatic Nucleic Acid
  misc_feature (18)..(25): n stands for any nucleotide and can be optionally absent
gaggccagcugaugaggnnnnnnnnccgaaagugagaa

SEQ ID NO: 7797 - RNA, 38 nt, Artificial Sequence
  Description of Artificial Sequence:  Enzymatic Nucleic Acid
  misc_feature (18)..(25): n stands for any nucleotide and can be optionally absent
aaacagcgcugaugaggnnnnnnnnccgaaaggccagg

SEQ ID NO: 7798 - RNA, 38 nt, Artificial Sequence
  Description of Artificial Sequence:  Enzymatic Nucleic Acid
  misc_feature (18)..(25): n stands for any nucleotide and can be optionally absent
gggcccgacugaugaggnnnnnnnnccgaaacagcgga

SEQ ID NO: 7799 - RNA, 38 nt, Artificial Sequence
  Description of Artificial Sequence:  Enzymatic Nucleic Acid
  misc_feature (18)..(25): n stands for any nucleotide and can be optionally absent
ggggcccgcugaugaggnnnnnnnnccgaaaacagcgg

SEQ ID NO: 7800 - RNA, 38 nt, Artificial Sequence
  Description of Artificial Sequence:  Enzymatic Nucleic Acid
  misc_feature (18)..(25): n stands for any nucleotide and can be optionally absent
gggggccccugaugaggnnnnnnnnccgaaaaacagcg

SEQ ID NO: 7801 - RNA, 38 nt, Artificial Sequence
  Description of Artificial Sequence:  Enzymatic Nucleic Acid
  misc_feature (18)..(25): n stands for any nucleotide and can be optionally absent
ccucuuggcugaugaggnnnnnnnnccgaaagggggcc

SEQ ID NO: 7802 - RNA, 38 nt, Artificial Sequence
  Description of Artificial Sequence:  Enzymatic Nucleic Acid
  misc_feature (18)..(25): n stands for any nucleotide and can be optionally absent
accucuugcugaugaggnnnnnnnnccgaaaagggggc

SEQ ID NO: 7803 - RNA, 38 nt, Artificial Sequence
  Description of Artificial Sequence:  Enzymatic Nucleic Acid
  misc_feature (18)..(25): n stands for any nucleotide and can be optionally absent
ugcucugacugaugaggnnnnnnnnccgaaaccucuug

SEQ ID NO: 7804 - RNA, 38 nt, Artificial Sequence
  Description of Artificial Sequence:  Enzymatic Nucleic Acid
  misc_feature (18)..(25): n stands for any nucleotide and can be optionally absent
ucugcucucugaugaggnnnnnnnnccgaaauaccucu

SEQ ID NO: 7805 - RNA, 38 nt, Artificial Sequence
  Description of Artificial Sequence:  Enzymatic Nucleic Acid
  misc_feature (18)..(25): n stands for any nucleotide and can be optionally absent
gucuaggacugaugaggnnnnnnnnccgaaacgucccu

SEQ ID NO: 7806 - RNA, 38 nt, Artificial Sequence
  Description of Artificial Sequence:  Enzymatic Nucleic Acid
  misc_feature (18)..(25): n stands for any nucleotide and can be optionally absent
ggucuaggcugaugaggnnnnnnnnccgaaaacguccc

SEQ ID NO: 7807 - RNA, 38 nt, Artificial Sequence
  Description of Artificial Sequence:  Enzymatic Nucleic Acid
  misc_feature (18)..(25): n stands for any nucleotide and can be optionally absent
uggucuagcugaugaggnnnnnnnnccgaaaaacgucc

SEQ ID NO: 7808 - RNA, 38 nt, Artificial Sequence
  Description of Artificial Sequence:  Enzymatic Nucleic Acid
  misc_feature (18)..(25): n stands for any nucleotide and can be optionally absent
cccugguccugaugaggnnnnnnnnccgaaaggaaacg

SEQ ID NO: 7809 - RNA, 38 nt, Artificial Sequence
  Description of Artificial Sequence:  Enzymatic Nucleic Acid
  misc_feature (18)..(25): n stands for any nucleotide and can be optionally absent
uucccgagcugaugaggnnnnnnnnccgaaacaugugc

SEQ ID NO: 7810 - RNA, 38 nt, Artificial Sequence
  Description of Artificial Sequence:  Enzymatic Nucleic Acid
  misc_feature (18)..(25): n stands for any nucleotide and can be optionally absent
guucccgacugaugaggnnnnnnnnccgaaaacaugug

SEQ ID NO: 7811 - RNA, 38 nt, Artificial Sequence
  Description of Artificial Sequence:  Enzymatic Nucleic Acid
  misc_feature (18)..(25): n stands for any nucleotide and can be optionally absent
ugguuccccugaugaggnnnnnnnnccgaaagaacaug

SEQ ID NO: 7812 - RNA, 38 nt, Artificial Sequence
  Description of Artificial Sequence:  Enzymatic Nucleic Acid
  misc_feature (18)..(25): n stands for any nucleotide and can be optionally absent
uuaagauucugaugaggnnnnnnnnccgaaacuguggu

SEQ ID NO: 7813 - RNA, 38 nt, Artificial Sequence
  Description of Artificial Sequence:  Enzymatic Nucleic Acid
  misc_feature (18)..(25): n stands for any nucleotide and can be optionally absent
uuuaagaucugaugaggnnnnnnnnccgaaaacugugg

SEQ ID NO: 7814 - RNA, 38 nt, Artificial Sequence
  Description of Artificial Sequence:  Enzymatic Nucleic Acid
  misc_feature (18)..(25): n stands for any nucleotide and can be optionally absent
agauuuaacugaugaggnnnnnnnnccgaaauuaacug

SEQ ID NO: 7815 - RNA, 38 nt, Artificial Sequence
  Description of Artificial Sequence:  Enzymatic Nucleic Acid
  misc_feature (18)..(25): n stands for any nucleotide and can be optionally absent
aaagauuucugaugaggnnnnnnnnccgaaagauuaac

SEQ ID NO: 7816 - RNA, 38 nt, Artificial Sequence
  Description of Artificial Sequence:  Enzymatic Nucleic Acid
  misc_feature (18)..(25): n stands for any nucleotide and can be optionally absent
aaaagauucugaugaggnnnnnnnnccgaaaagauuaa

SEQ ID NO: 7817 - RNA, 38 nt, Artificial Sequence
  Description of Artificial Sequence:  Enzymatic Nucleic Acid
  misc_feature (18)..(25): n stands for any nucleotide and can be optionally absent
cgggaaaacugaugaggnnnnnnnnccgaaauuuaaga

SEQ ID NO: 7818 - RNA, 38 nt, Artificial Sequence
  Description of Artificial Sequence:  Enzymatic Nucleic Acid
  misc_feature (18)..(25): n stands for any nucleotide and can be optionally absent
cccgggaacugaugaggnnnnnnnnccgaaagauuuaa

SEQ ID NO: 7819 - RNA, 38 nt, Artificial Sequence
  Description of Artificial Sequence:  Enzymatic Nucleic Acid
  misc_feature (18)..(25): n stands for any nucleotide and can be optionally absent
ucccgggacugaugaggnnnnnnnnccgaaaagauuua

SEQ ID NO: 7820 - RNA, 38 nt, Artificial Sequence
  Description of Artificial Sequence:  Enzymatic Nucleic Acid
  misc_feature (18)..(25): n stands for any nucleotide and can be optionally absent
cucccgggcugaugaggnnnnnnnnccgaaaaagauuu

SEQ ID NO: 7821 - RNA, 38 nt, Artificial Sequence
  Description of Artificial Sequence:  Enzymatic Nucleic Acid
  misc_feature (18)..(25): n stands for any nucleotide and can be optionally absent
acucccggcugaugaggnnnnnnnnccgaaaaaagauu

SEQ ID NO: 7822 - RNA, 38 nt, Artificial Sequence
  Description of Artificial Sequence:  Enzymatic Nucleic Acid
  misc_feature (18)..(25): n stands for any nucleotide and can be optionally absent
caacagaacugaugaggnnnnnnnnccgaaacucccgg

SEQ ID NO: 7823 - RNA, 38 nt, Artificial Sequence
  Description of Artificial Sequence:  Enzymatic Nucleic Acid
  misc_feature (18)..(25): n stands for any nucleotide and can be optionally absent
gacaacagcugaugaggnnnnnnnnccgaaagacuccc

SEQ ID NO: 7824 - RNA, 38 nt, Artificial Sequence
  Description of Artificial Sequence:  Enzymatic Nucleic Acid
  misc_feature (18)..(25): n stands for any nucleotide and can be optionally absent
agacaacacugaugaggnnnnnnnnccgaaaagacucc

SEQ ID NO: 7825 - RNA, 38 nt, Artificial Sequence
  Description of Artificial Sequence:  Enzymatic Nucleic Acid
  misc_feature (18)..(25): n stands for any nucleotide and can be optionally absent
aaacagaccugaugaggnnnnnnnnccgaaacagaaga

SEQ ID NO: 7826 - RNA, 38 nt, Artificial Sequence
  Description of Artificial Sequence:  Enzymatic Nucleic Acid
  misc_feature (18)..(25): n stands for any nucleotide and can be optionally absent
gguaaacacugaugaggnnnnnnnnccgaaacaacaga

SEQ ID NO: 7827 - RNA, 38 nt, Artificial Sequence
  Description of Artificial Sequence:  Enzymatic Nucleic Acid
  misc_feature (18)..(25): n stands for any nucleotide and can be optionally absent
ggaugguacugaugaggnnnnnnnnccgaaacagacaa

SEQ ID NO: 7828 - RNA, 38 nt, Artificial Sequence
  Description of Artificial Sequence:  Enzymatic Nucleic Acid
  misc_feature (18)..(25): n stands for any nucleotide and can be optionally absent
uggauggucugaugaggnnnnnnnnccgaaaacagaca

SEQ ID NO: 7829 - RNA, 38 nt, Artificial Sequence
  Description of Artificial Sequence:  Enzymatic Nucleic Acid
  misc_feature (18)..(25): n stands for any nucleotide and can be optionally absent
uuggauggcugaugaggnnnnnnnnccgaaaaacagac

SEQ ID NO: 7830 - RNA, 38 nt, Artificial Sequence
  Description of Artificial Sequence:  Enzymatic Nucleic Acid
  misc_feature (18)..(25): n stands for any nucleotide and can be optionally absent
augcuuugcugaugaggnnnnnnnnccgaaaugguaaa

SEQ ID NO: 7831 - RNA, 38 nt, Artificial Sequence
  Description of Artificial Sequence:  Enzymatic Nucleic Acid
  misc_feature (18)..(25): n stands for any nucleotide and can be optionally absent
auguuaaacugaugaggnnnnnnnnccgaaaugcuuug

SEQ ID NO: 7832 - RNA, 38 nt, Artificial Sequence
  Description of Artificial Sequence:  Enzymatic Nucleic Acid
  misc_feature (18)..(25): n stands for any nucleotide and can be optionally absent
acauguuacugaugaggnnnnnnnnccgaaauaugcuu

SEQ ID NO: 7833 - RNA, 38 nt, Artificial Sequence
  Description of Artificial Sequence:  Enzymatic Nucleic Acid
  misc_feature (18)..(25): n stands for any nucleotide and can be optionally absent
cacauguucugaugaggnnnnnnnnccgaaaauaugcu

SEQ ID NO: 7834 - RNA, 38 nt, Artificial Sequence
  Description of Artificial Sequence:  Enzymatic Nucleic Acid
  misc_feature (18)..(25): n stands for any nucleotide and can be optionally absent
acacaugucugaugaggnnnnnnnnccgaaaaauaugc

SEQ ID NO: 7835 - RNA, 38 nt, Artificial Sequence
  Description of Artificial Sequence:  Enzymatic Nucleic Acid
  misc_feature (18)..(25): n stands for any nucleotide and can be optionally absent
cccccacucugaugaggnnnnnnnnccgaaacacaugu

SEQ ID NO: 7836 - RNA, 38 nt, Artificial Sequence
  Description of Artificial Sequence:  Enzymatic Nucleic Acid
  misc_feature (18)..(25): n stands for any nucleotide and can be optionally absent
cagaagcccugaugaggnnnnnnnnccgaaagcgccac

SEQ ID NO: 7837 - RNA, 38 nt, Artificial Sequence
  Description of Artificial Sequence:  Enzymatic Nucleic Acid
  misc_feature (18)..(25): n stands for any nucleotide and can be optionally absent
ggccucagcugaugaggnnnnnnnnccgaaagccaagc

SEQ ID NO: 7838 - RNA, 38 nt, Artificial Sequence
  Description of Artificial Sequence:  Enzymatic Nucleic Acid
  misc_feature (18)..(25): n stands for any nucleotide and can be optionally absent
uggccucacugaugaggnnnnnnnnccgaaaagccaag

SEQ ID NO: 7839 - RNA, 38 nt, Artificial Sequence
  Description of Artificial Sequence:  Enzymatic Nucleic Acid
  misc_feature (18)..(25): n stands for any nucleotide and can be optionally absent
gaacugaucugaugaggnnnnnnnnccgaaauggcucu

SEQ ID NO: 7840 - RNA, 38 nt, Artificial Sequence
  Description of Artificial Sequence:  Enzymatic Nucleic Acid
  misc_feature (18)..(25): n stands for any nucleotide and can be optionally absent
gaggaacucugaugaggnnnnnnnnccgaaaugauggc

SEQ ID NO: 7841 - RNA, 38 nt, Artificial Sequence
  Description of Artificial Sequence:  Enzymatic Nucleic Acid
  misc_feature (18)..(25): n stands for any nucleotide and can be optionally absent
acuagaggcugaugaggnnnnnnnnccgaaacugauga

SEQ ID NO: 7842 - RNA, 38 nt, Artificial Sequence
  Description of Artificial Sequence:  Enzymatic Nucleic Acid
  misc_feature (18)..(25): n stands for any nucleotide and can be optionally absent
cacuagagcugaugaggnnnnnnnnccgaaaacugaug

SEQ ID NO: 7843 - RNA, 38 nt, Artificial Sequence
  Description of Artificial Sequence:  Enzymatic Nucleic Acid
  misc_feature (18)..(25): n stands for any nucleotide and can be optionally absent
ucucacuacugaugaggnnnnnnnnccgaaaggaacug

SEQ ID NO: 7844 - RNA, 38 nt, Artificial Sequence
  Description of Artificial Sequence:  Enzymatic Nucleic Acid
  misc_feature (18)..(25): n stands for any nucleotide and can be optionally absent
caucucaccugaugaggnnnnnnnnccgaaagaggaac

SEQ ID NO: 7845 - RNA, 38 nt, Artificial Sequence
  Description of Artificial Sequence:  Enzymatic Nucleic Acid
  misc_feature (18)..(25): n stands for any nucleotide and can be optionally absent
augaccuccugaugaggnnnnnnnnccgaaaugcaucu

SEQ ID NO: 7846 - RNA, 38 nt, Artificial Sequence
  Description of Artificial Sequence:  Enzymatic Nucleic Acid
  misc_feature (18)..(25): n stands for any nucleotide and can be optionally absent
uuggguaucugaugaggnnnnnnnnccgaaaccucaau

SEQ ID NO: 7847 - RNA, 38 nt, Artificial Sequence
  Description of Artificial Sequence:  Enzymatic Nucleic Acid
  misc_feature (18)..(25): n stands for any nucleotide and can be optionally absent
agcuugggcugaugaggnnnnnnnnccgaaaugaccuc

SEQ ID NO: 7848 - RNA, 38 nt, Artificial Sequence
  Description of Artificial Sequence:  Enzymatic Nucleic Acid
  misc_feature (18)..(25): n stands for any nucleotide and can be optionally absent
aggccugccugaugaggnnnnnnnnccgaaagcuuggg

SEQ ID NO: 7849 - RNA, 38 nt, Artificial Sequence
  Description of Artificial Sequence:  Enzymatic Nucleic Acid
  misc_feature (18)..(25): n stands for any nucleotide and can be optionally absent
aguaugcgcugaugaggnnnnnnnnccgaaaggucagg

SEQ ID NO: 7850 - RNA, 38 nt, Artificial Sequence
  Description of Artificial Sequence:  Enzymatic Nucleic Acid
  misc_feature (18)..(25): n stands for any nucleotide and can be optionally absent
caguaugccugaugaggnnnnnnnnccgaaaaggucag

SEQ ID NO: 7851 - RNA, 38 nt, Artificial Sequence
  Description of Artificial Sequence:  Enzymatic Nucleic Acid
  misc_feature (18)..(25): n stands for any nucleotide and can be optionally absent
gugagcagcugaugaggnnnnnnnnccgaaaugcgaag

SEQ ID NO: 7852 - RNA, 38 nt, Artificial Sequence
  Description of Artificial Sequence:  Enzymatic Nucleic Acid
  misc_feature (18)..(25): n stands for any nucleotide and can be optionally absent
cuccccgucugaugaggnnnnnnnnccgaaagcaguau

SEQ ID NO: 7853 - RNA, 38 nt, Artificial Sequence
  Description of Artificial Sequence:  Enzymatic Nucleic Acid
  misc_feature (18)..(25): n stands for any nucleotide and can be optionally absent
gaccacuucugaugaggnnnnnnnnccgaaacuccccg

SEQ ID NO: 7854 - RNA, 38 nt, Artificial Sequence
  Description of Artificial Sequence:  Enzymatic Nucleic Acid
  misc_feature (18)..(25): n stands for any nucleotide and can be optionally absent
ggaccacucugaugaggnnnnnnnnccgaaaacucccc

SEQ ID NO: 7855 - RNA, 38 nt, Artificial Sequence
  Description of Artificial Sequence:  Enzymatic Nucleic Acid
  misc_feature (18)..(25): n stands for any nucleotide and can be optionally absent
ccaaacugcugaugaggnnnnnnnnccgaaaccacuua

SEQ ID NO: 7856 - RNA, 38 nt, Artificial Sequence
  Description of Artificial Sequence:  Enzymatic Nucleic Acid
  misc_feature (18)..(25): n stands for any nucleotide and can be optionally absent
cuaggccacugaugaggnnnnnnnnccgaaacuggacc

SEQ ID NO: 7857 - RNA, 38 nt, Artificial Sequence
  Description of Artificial Sequence:  Enzymatic Nucleic Acid
  misc_feature (18)..(25): n stands for any nucleotide and can be optionally absent
acuaggcccugaugaggnnnnnnnnccgaaaacuggac

SEQ ID NO: 7858 - RNA, 38 nt, Artificial Sequence
  Description of Artificial Sequence:  Enzymatic Nucleic Acid
  misc_feature (18)..(25): n stands for any nucleotide and can be optionally absent
aaccuuaccugaugaggnnnnnnnnccgaaaggccaaa

SEQ ID NO: 7859 - RNA, 38 nt, Artificial Sequence
  Description of Artificial Sequence:  Enzymatic Nucleic Acid
  misc_feature (18)..(25): n stands for any nucleotide and can be optionally absent
ggcaaccucugaugaggnnnnnnnnccgaaacuaggcc

SEQ ID NO: 7860 - RNA, 38 nt, Artificial Sequence
  Description of Artificial Sequence:  Enzymatic Nucleic Acid
  misc_feature (18)..(25): n stands for any nucleotide and can be optionally absent
caguaggccugaugaggnnnnnnnnccgaaaccuuacu

SEQ ID NO: 7861 - RNA, 38 nt, Artificial Sequence
  Description of Artificial Sequence:  Enzymatic Nucleic Acid
  misc_feature (18)..(25): n stands for any nucleotide and can be optionally absent
cccaucagcugaugaggnnnnnnnnccgaaaggcaacc

SEQ ID NO: 7862 - RNA, 38 nt, Artificial Sequence
  Description of Artificial Sequence:  Enzymatic Nucleic Acid
  misc_feature (18)..(25): n stands for any nucleotide and can be optionally absent
uggcuuuucugaugaggnnnnnnnnccgaaagcccauc

SEQ ID NO: 7863 - RNA, 38 nt, Artificial Sequence
  Description of Artificial Sequence:  Enzymatic Nucleic Acid
  misc_feature (18)..(25): n stands for any nucleotide and can be optionally absent
cuguuuaacugaugaggnnnnnnnnccgaaauguggcu

SEQ ID NO: 7864 - RNA, 38 nt, Artificial Sequence
  Description of Artificial Sequence:  Enzymatic Nucleic Acid
  misc_feature (18)..(25): n stands for any nucleotide and can be optionally absent
ccuguuuacugaugaggnnnnnnnnccgaaaauguggc

SEQ ID NO: 7865 - RNA, 38 nt, Artificial Sequence
  Description of Artificial Sequence:  Enzymatic Nucleic Acid
  misc_feature (18)..(25): n stands for any nucleotide and can be optionally absent
accuguuucugaugaggnnnnnnnnccgaaaaaugugg

SEQ ID NO: 7866 - RNA, 38 nt, Artificial Sequence
  Description of Artificial Sequence:  Enzymatic Nucleic Acid
  misc_feature (18)..(25): n stands for any nucleotide and can be optionally absent
aaccuguucugaugaggnnnnnnnnccgaaaaaaugug

SEQ ID NO: 7867 - RNA, 38 nt, Artificial Sequence
  Description of Artificial Sequence:  Enzymatic Nucleic Acid
  misc_feature (18)..(25): n stands for any nucleotide and can be optionally absent
ugagauaacugaugaggnnnnnnnnccgaaaccuguuu

SEQ ID NO: 7868 - RNA, 38 nt, Artificial Sequence
  Description of Artificial Sequence:  Enzymatic Nucleic Acid
  misc_feature (18)..(25): n stands for any nucleotide and can be optionally absent
uugagauacugaugaggnnnnnnnnccgaaaaccuguu

SEQ ID NO: 7869 - RNA, 38 nt, Artificial Sequence
  Description of Artificial Sequence:  Enzymatic Nucleic Acid
  misc_feature (18)..(25): n stands for any nucleotide and can be optionally absent
cuugagaucugaugaggnnnnnnnnccgaaaaaccugu

SEQ ID NO: 7870 - RNA, 38 nt, Artificial Sequence
  Description of Artificial Sequence:  Enzymatic Nucleic Acid
  misc_feature (18)..(25): n stands for any nucleotide and can be optionally absent
acuugagacugaugaggnnnnnnnnccgaaaaaaccug

SEQ ID NO: 7871 - RNA, 38 nt, Artificial Sequence
  Description of Artificial Sequence:  Enzymatic Nucleic Acid
  misc_feature (18)..(25): n stands for any nucleotide and can be optionally absent
auacuugacugaugaggnnnnnnnnccgaaauaaaacc

SEQ ID NO: 7872 - RNA, 38 nt, Artificial Sequence
  Description of Artificial Sequence:  Enzymatic Nucleic Acid
  misc_feature (18)..(25): n stands for any nucleotide and can be optionally absent
uaauacuucugaugaggnnnnnnnnccgaaagauaaaa

SEQ ID NO: 7873 - RNA, 38 nt, Artificial Sequence
  Description of Artificial Sequence:  Enzymatic Nucleic Acid
  misc_feature (18)..(25): n stands for any nucleotide and can be optionally absent
uauauuaacugaugaggnnnnnnnnccgaaacuugaga

SEQ ID NO: 7874 - RNA, 38 nt, Artificial Sequence
  Description of Artificial Sequence:  Enzymatic Nucleic Acid
  misc_feature (18)..(25): n stands for any nucleotide and can be optionally absent
uauauauucugaugaggnnnnnnnnccgaaauacuuga

SEQ ID NO: 7875 - RNA, 38 nt, Artificial Sequence
  Description of Artificial Sequence:  Enzymatic Nucleic Acid
  misc_feature (18)..(25): n stands for any nucleotide and can be optionally absent
cuauauaucugaugaggnnnnnnnnccgaaaauacuug

SEQ ID NO: 7876 - RNA, 38 nt, Artificial Sequence
  Description of Artificial Sequence:  Enzymatic Nucleic Acid
  misc_feature (18)..(25): n stands for any nucleotide and can be optionally absent
ugucuauacugaugaggnnnnnnnnccgaaauuaauac

SEQ ID NO: 7877 - RNA, 38 nt, Artificial Sequence
  Description of Artificial Sequence:  Enzymatic Nucleic Acid
  misc_feature (18)..(25): n stands for any nucleotide and can be optionally absent
cuugucuacugaugaggnnnnnnnnccgaaauauuaau

SEQ ID NO: 7878 - RNA, 38 nt, Artificial Sequence
  Description of Artificial Sequence:  Enzymatic Nucleic Acid
  misc_feature (18)..(25): n stands for any nucleotide and can be optionally absent
gucuuguccugaugaggnnnnnnnnccgaaauauauua

SEQ ID NO: 7879 - RNA, 38 nt, Artificial Sequence
  Description of Artificial Sequence:  Enzymatic Nucleic Acid
  misc_feature (18)..(25): n stands for any nucleotide and can be optionally absent
uaaugcaucugaugaggnnnnnnnnccgaaagugucuu

SEQ ID NO: 7880 - RNA, 38 nt, Artificial Sequence
  Description of Artificial Sequence:  Enzymatic Nucleic Acid
  misc_feature (18)..(25): n stands for any nucleotide and can be optionally absent
auaaugcacugaugaggnnnnnnnnccgaaaagugucu

SEQ ID NO: 7881 - RNA, 38 nt, Artificial Sequence
  Description of Artificial Sequence:  Enzymatic Nucleic Acid
  misc_feature (18)..(25): n stands for any nucleotide and can be optionally absent
aacaggaucugaugaggnnnnnnnnccgaaaugcauaa

SEQ ID NO: 7882 - RNA, 38 nt, Artificial Sequence
  Description of Artificial Sequence:  Enzymatic Nucleic Acid
  misc_feature (18)..(25): n stands for any nucleotide and can be optionally absent
aaacaggacugaugaggnnnnnnnnccgaaaaugcaua

SEQ ID NO: 7883 - RNA, 38 nt, Artificial Sequence
  Description of Artificial Sequence:  Enzymatic Nucleic Acid
  misc_feature (18)..(25): n stands for any nucleotide and can be optionally absent
uaaaacagcugaugaggnnnnnnnnccgaaauaaugca

SEQ ID NO: 7884 - RNA, 38 nt, Artificial Sequence
  Description of Artificial Sequence:  Enzymatic Nucleic Acid
  misc_feature (18)..(25): n stands for any nucleotide and can be optionally absent
auauauaacugaugaggnnnnnnnnccgaaacaggaua

SEQ ID NO: 7885 - RNA, 38 nt, Artificial Sequence
  Description of Artificial Sequence:  Enzymatic Nucleic Acid
  misc_feature (18)..(25): n stands for any nucleotide and can be optionally absent
gauauauacugaugaggnnnnnnnnccgaaaacaggau

SEQ ID NO: 7886 - RNA, 38 nt, Artificial Sequence
  Description of Artificial Sequence:  Enzymatic Nucleic Acid
  misc_feature (18)..(25): n stands for any nucleotide and can be optionally absent
ggauauaucugaugaggnnnnnnnnccgaaaaacagga

SEQ ID NO: 7887 - RNA, 38 nt, Artificial Sequence
  Description of Artificial Sequence:  Enzymatic Nucleic Acid
  misc_feature (18)..(25): n stands for any nucleotide and can be optionally absent
uggauauacugaugaggnnnnnnnnccgaaaaaacagg

SEQ ID NO: 7888 - RNA, 38 nt, Artificial Sequence
  Description of Artificial Sequence:  Enzymatic Nucleic Acid
  misc_feature (18)..(25): n stands for any nucleotide and can be optionally absent
auuggauacugaugaggnnnnnnnnccgaaauaaaaca

SEQ ID NO: 7889 - RNA, 38 nt, Artificial Sequence
  Description of Artificial Sequence:  Enzymatic Nucleic Acid
  misc_feature (18)..(25): n stands for any nucleotide and can be optionally absent
ucauuggacugaugaggnnnnnnnnccgaaauauaaaa

SEQ ID NO: 7890 - RNA, 38 nt, Artificial Sequence
  Description of Artificial Sequence:  Enzymatic Nucleic Acid
  misc_feature (18)..(25): n stands for any nucleotide and can be optionally absent
auucauugcugaugaggnnnnnnnnccgaaauauauaa

SEQ ID NO: 7891 - RNA, 38 nt, Artificial Sequence
  Description of Artificial Sequence:  Enzymatic Nucleic Acid
  misc_feature (18)..(25): n stands for any nucleotide and can be optionally absent
cccaguuacugaugaggnnnnnnnnccgaaauucauug

SEQ ID NO: 7892 - RNA, 38 nt, Artificial Sequence
  Description of Artificial Sequence:  Enzymatic Nucleic Acid
  misc_feature (18)..(25): n stands for any nucleotide and can be optionally absent
gccccagucugaugaggnnnnnnnnccgaaauauucau

SEQ ID NO: 7893 - RNA, 38 nt, Artificial Sequence
  Description of Artificial Sequence:  Enzymatic Nucleic Acid
  misc_feature (18)..(25): n stands for any nucleotide and can be optionally absent
ugacucuucugaugaggnnnnnnnnccgaaacucgccc

SEQ ID NO: 7894 - RNA, 38 nt, Artificial Sequence
  Description of Artificial Sequence:  Enzymatic Nucleic Acid
  misc_feature (18)..(25): n stands for any nucleotide and can be optionally absent
augacucucugaugaggnnnnnnnnccgaaaacucgcc

SEQ ID NO: 7895 - RNA, 38 nt, Artificial Sequence
  Description of Artificial Sequence:  Enzymatic Nucleic Acid
  misc_feature (18)..(25): n stands for any nucleotide and can be optionally absent
uagaccaucugaugaggnnnnnnnnccgaaacucuuaa

SEQ ID NO: 7896 - RNA, 38 nt, Artificial Sequence
  Description of Artificial Sequence:  Enzymatic Nucleic Acid
  misc_feature (18)..(25): n stands for any nucleotide and can be optionally absent
cuuuucuacugaugaggnnnnnnnnccgaaaccaugac

SEQ ID NO: 7897 - RNA, 38 nt, Artificial Sequence
  Description of Artificial Sequence:  Enzymatic Nucleic Acid
  misc_feature (18)..(25): n stands for any nucleotide and can be optionally absent
cccuuuuccugaugaggnnnnnnnnccgaaagaccaug

SEQ ID NO: 7898 - RNA, 38 nt, Artificial Sequence
  Description of Artificial Sequence:  Enzymatic Nucleic Acid
  misc_feature (18)..(25): n stands for any nucleotide and can be optionally absent
uacagagacugaugaggnnnnnnnnccgaaaccccuuu

SEQ ID NO: 7899 - RNA, 38 nt, Artificial Sequence
  Description of Artificial Sequence:  Enzymatic Nucleic Acid
  misc_feature (18)..(25): n stands for any nucleotide and can be optionally absent
guacagagcugaugaggnnnnnnnnccgaaaaccccuu

SEQ ID NO: 7900 - RNA, 38 nt, Artificial Sequence
  Description of Artificial Sequence:  Enzymatic Nucleic Acid
  misc_feature (18)..(25): n stands for any nucleotide and can be optionally absent
gguacagacugaugaggnnnnnnnnccgaaaaaccccu

SEQ ID NO: 7901 - RNA, 38 nt, Artificial Sequence
  Description of Artificial Sequence:  Enzymatic Nucleic Acid
  misc_feature (18)..(25): n stands for any nucleotide and can be optionally absent
uggguacacugaugaggnnnnnnnnccgaaagaaaccc

SEQ ID NO: 7902 - RNA, 38 nt, Artificial Sequence
  Description of Artificial Sequence:  Enzymatic Nucleic Acid
  misc_feature (18)..(25): n stands for any nucleotide and can be optionally absent
gauuugggcugaugaggnnnnnnnnccgaaacagagaa

SEQ ID NO: 7903 - RNA, 38 nt, Artificial Sequence
  Description of Artificial Sequence:  Enzymatic Nucleic Acid
  misc_feature (18)..(25): n stands for any nucleotide and can be optionally absent
accagccccugaugaggnnnnnnnnccgaaauuugggu

SEQ ID NO: 7904 - RNA, 38 nt, Artificial Sequence
  Description of Artificial Sequence:  Enzymatic Nucleic Acid
  misc_feature (18)..(25): n stands for any nucleotide and can be optionally absent
cuuggucccugaugaggnnnnnnnnccgaaaccagccc

SEQ ID NO: 7905 - RNA, 38 nt, Artificial Sequence
  Description of Artificial Sequence:  Enzymatic Nucleic Acid
  misc_feature (18)..(25): n stands for any nucleotide and can be optionally absent
gcugggaccugaugaggnnnnnnnnccgaaaccacucu

SEQ ID NO: 7906 - RNA, 38 nt, Artificial Sequence
  Description of Artificial Sequence:  Enzymatic Nucleic Acid
  misc_feature (18)..(25): n stands for any nucleotide and can be optionally absent
auagcuggcugaugaggnnnnnnnnccgaaacaaccac

SEQ ID NO: 7907 - RNA, 38 nt, Artificial Sequence
  Description of Artificial Sequence:  Enzymatic Nucleic Acid
  misc_feature (18)..(25): n stands for any nucleotide and can be optionally absent
aguaacuacugaugaggnnnnnnnnccgaaagcuggga

SEQ ID NO: 7908 - RNA, 38 nt, Artificial Sequence
  Description of Artificial Sequence:  Enzymatic Nucleic Acid
  misc_feature (18)..(25): n stands for any nucleotide and can be optionally absent
uuaguaaccugaugaggnnnnnnnnccgaaauagcugg

SEQ ID NO: 7909 - RNA, 38 nt, Artificial Sequence
  Description of Artificial Sequence:  Enzymatic Nucleic Acid
  misc_feature (18)..(25): n stands for any nucleotide and can be optionally absent
aguuuagucugaugaggnnnnnnnnccgaaacuauagc

SEQ ID NO: 7910 - RNA, 38 nt, Artificial Sequence
  Description of Artificial Sequence:  Enzymatic Nucleic Acid
  misc_feature (18)..(25): n stands for any nucleotide and can be optionally absent
uaguuuagcugaugaggnnnnnnnnccgaaaacuauag

SEQ ID NO: 7911 - RNA, 38 nt, Artificial Sequence
  Description of Artificial Sequence:  Enzymatic Nucleic Acid
  misc_feature (18)..(25): n stands for any nucleotide and can be optionally absent
gaguaguucugaugaggnnnnnnnnccgaaaguaacua

SEQ ID NO: 7912 - RNA, 38 nt, Artificial Sequence
  Description of Artificial Sequence:  Enzymatic Nucleic Acid
  misc_feature (18)..(25): n stands for any nucleotide and can be optionally absent
ugggugagcugaugaggnnnnnnnnccgaaaguuuagu

SEQ ID NO: 7913 - RNA, 38 nt, Artificial Sequence
  Description of Artificial Sequence:  Enzymatic Nucleic Acid
  misc_feature (18)..(25): n stands for any nucleotide and can be optionally absent
cuuugggucugaugaggnnnnnnnnccgaaaguaguuu

SEQ ID NO: 7914 - RNA, 38 nt, Artificial Sequence
  Description of Artificial Sequence:  Enzymatic Nucleic Acid
  misc_feature (18)..(25): n stands for any nucleotide and can be optionally absent
gagguccccugaugaggnnnnnnnnccgaaacuuuggg

SEQ ID NO: 7915 - RNA, 38 nt, Artificial Sequence
  Description of Artificial Sequence:  Enzymatic Nucleic Acid
  misc_feature (18)..(25): n stands for any nucleotide and can be optionally absent
aagccagucugaugaggnnnnnnnnccgaaagguccca

SEQ ID NO: 7916 - RNA, 38 nt, Artificial Sequence
  Description of Artificial Sequence:  Enzymatic Nucleic Acid
  misc_feature (18)..(25): n stands for any nucleotide and can be optionally absent
guaaagagcugaugaggnnnnnnnnccgaaagccagug

SEQ ID NO: 7917 - RNA, 38 nt, Artificial Sequence
  Description of Artificial Sequence:  Enzymatic Nucleic Acid
  misc_feature (18)..(25): n stands for any nucleotide and can be optionally absent
aguaaagacugaugaggnnnnnnnnccgaaaagccagu

SEQ ID NO: 7918 - RNA, 38 nt, Artificial Sequence
  Description of Artificial Sequence:  Enzymatic Nucleic Acid
  misc_feature (18)..(25): n stands for any nucleotide and can be optionally absent
gaaguaaacugaugaggnnnnnnnnccgaaagaagcca

SEQ ID NO: 7919 - RNA, 38 nt, Artificial Sequence
  Description of Artificial Sequence:  Enzymatic Nucleic Acid
  misc_feature (18)..(25): n stands for any nucleotide and can be optionally absent
augaaguacugaugaggnnnnnnnnccgaaagagaagc

SEQ ID NO: 7920 - RNA, 38 nt, Artificial Sequence
  Description of Artificial Sequence:  Enzymatic Nucleic Acid
  misc_feature (18)..(25): n stands for any nucleotide and can be optionally absent
gaugaagucugaugaggnnnnnnnnccgaaaagagaag

SEQ ID NO: 7921 - RNA, 38 nt, Artificial Sequence
  Description of Artificial Sequence:  Enzymatic Nucleic Acid
  misc_feature (18)..(25): n stands for any nucleotide and can be optionally absent
ugaugaagcugaugaggnnnnnnnnccgaaaaagagaa

SEQ ID NO: 7922 - RNA, 38 nt, Artificial Sequence
  Description of Artificial Sequence:  Enzymatic Nucleic Acid
  misc_feature (18)..(25): n stands for any nucleotide and can be optionally absent
ccaugaugcugaugaggnnnnnnnnccgaaaguaaaga

SEQ ID NO: 7923 - RNA, 38 nt, Artificial Sequence
  Description of Artificial Sequence:  Enzymatic Nucleic Acid
  misc_feature (18)..(25): n stands for any nucleotide and can be optionally absent
uccaugaucugaugaggnnnnnnnnccgaaaaguaaag

SEQ ID NO: 7924 - RNA, 38 nt, Artificial Sequence
  Description of Artificial Sequence:  Enzymatic Nucleic Acid
  misc_feature (18)..(25): n stands for any nucleotide and can be optionally absent
aaauccaucugaugaggnnnnnnnnccgaaaugaagua

SEQ ID NO: 7925 - RNA, 38 nt, Artificial Sequence
  Description of Artificial Sequence:  Enzymatic Nucleic Acid
  misc_feature (18)..(25): n stands for any nucleotide and can be optionally absent
gauggugacugaugaggnnnnnnnnccgaaauccauga

SEQ ID NO: 7926 - RNA, 38 nt, Artificial Sequence
  Description of Artificial Sequence:  Enzymatic Nucleic Acid
  misc_feature (18)..(25): n stands for any nucleotide and can be optionally absent
ggauggugcugaugaggnnnnnnnnccgaaaauccaug

SEQ ID NO: 7927 - RNA, 38 nt, Artificial Sequence
  Description of Artificial Sequence:  Enzymatic Nucleic Acid
  misc_feature (18)..(25): n stands for any nucleotide and can be optionally absent
gggauggucugaugaggnnnnnnnnccgaaaaauccau

SEQ ID NO: 7928 - RNA, 38 nt, Artificial Sequence
  Description of Artificial Sequence:  Enzymatic Nucleic Acid
  misc_feature (18)..(25): n stands for any nucleotide and can be optionally absent
ugccuuggcugaugaggnnnnnnnnccgaaauggugaa

SEQ ID NO: 7929 - RNA, 38 nt, Artificial Sequence
  Description of Artificial Sequence:  Enzymatic Nucleic Acid
  misc_feature (18)..(25): n stands for any nucleotide and can be optionally absent
uccucucacugaugaggnnnnnnnnccgaaacugccuu

SEQ ID NO: 7930 - RNA, 38 nt, Artificial Sequence
  Description of Artificial Sequence:  Enzymatic Nucleic Acid
  misc_feature (18)..(25): n stands for any nucleotide and can be optionally absent
auacucuucugaugaggnnnnnnnnccgaaagcuccuc

SEQ ID NO: 7931 - RNA, 38 nt, Artificial Sequence
  Description of Artificial Sequence:  Enzymatic Nucleic Acid
  misc_feature (18)..(25): n stands for any nucleotide and can be optionally absent
ugggcugacugaugaggnnnnnnnnccgaaacucuuua

SEQ ID NO: 7932 - RNA, 38 nt, Artificial Sequence
  Description of Artificial Sequence:  Enzymatic Nucleic Acid
  misc_feature (18)..(25): n stands for any nucleotide and can be optionally absent
uaugggcucugaugaggnnnnnnnnccgaaauacucuu

SEQ ID NO: 7933 - RNA, 38 nt, Artificial Sequence
  Description of Artificial Sequence:  Enzymatic Nucleic Acid
  misc_feature (18)..(25): n stands for any nucleotide and can be optionally absent
uuaauaaacugaugaggnnnnnnnnccgaaaugggcug

SEQ ID NO: 7934 - RNA, 38 nt, Artificial Sequence
  Description of Artificial Sequence:  Enzymatic Nucleic Acid
  misc_feature (18)..(25): n stands for any nucleotide and can be optionally absent
gcuuaauacugaugaggnnnnnnnnccgaaauaugggc

SEQ ID NO: 7935 - RNA, 38 nt, Artificial Sequence
  Description of Artificial Sequence:  Enzymatic Nucleic Acid
  misc_feature (18)..(25): n stands for any nucleotide and can be optionally absent
ugcuuaaucugaugaggnnnnnnnnccgaaaauauggg

SEQ ID NO: 7936 - RNA, 38 nt, Artificial Sequence
  Description of Artificial Sequence:  Enzymatic Nucleic Acid
  misc_feature (18)..(25): n stands for any nucleotide and can be optionally absent
gugcuuaacugaugaggnnnnnnnnccgaaaaauaugg

SEQ ID NO: 7937 - RNA, 38 nt, Artificial Sequence
  Description of Artificial Sequence:  Enzymatic Nucleic Acid
  misc_feature (18)..(25): n stands for any nucleotide and can be optionally absent
aagugcuucugaugaggnnnnnnnnccgaaauaaauau

SEQ ID NO: 7938 - RNA, 38 nt, Artificial Sequence
  Description of Artificial Sequence:  Enzymatic Nucleic Acid
  misc_feature (18)..(25): n stands for any nucleotide and can be optionally absent
aaagugcucugaugaggnnnnnnnnccgaaaauaaaua

SEQ ID NO: 7939 - RNA, 38 nt, Artificial Sequence
  Description of Artificial Sequence:  Enzymatic Nucleic Acid
  misc_feature (18)..(25): n stands for any nucleotide and can be optionally absent
ggagcauacugaugaggnnnnnnnnccgaaagugcuua

SEQ ID NO: 7940 - RNA, 38 nt, Artificial Sequence
  Description of Artificial Sequence:  Enzymatic Nucleic Acid
  misc_feature (18)..(25): n stands for any nucleotide and can be optionally absent
aggagcaucugaugaggnnnnnnnnccgaaaagugcuu

SEQ ID NO: 7941 - RNA, 38 nt, Artificial Sequence
  Description of Artificial Sequence:  Enzymatic Nucleic Acid
  misc_feature (18)..(25): n stands for any nucleotide and can be optionally absent
aaggagcacugaugaggnnnnnnnnccgaaaaagugcu

SEQ ID NO: 7942 - RNA, 38 nt, Artificial Sequence
  Description of Artificial Sequence:  Enzymatic Nucleic Acid
  misc_feature (18)..(25): n stands for any nucleotide and can be optionally absent
gugccaagcugaugaggnnnnnnnnccgaaagcauaaa

SEQ ID NO: 7943 - RNA, 38 nt, Artificial Sequence
  Description of Artificial Sequence:  Enzymatic Nucleic Acid
  misc_feature (18)..(25): n stands for any nucleotide and can be optionally absent
gcugugcccugaugaggnnnnnnnnccgaaaggagcau

SEQ ID NO: 7944 - RNA, 38 nt, Artificial Sequence
  Description of Artificial Sequence:  Enzymatic Nucleic Acid
  misc_feature (18)..(25): n stands for any nucleotide and can be optionally absent
gcauaaaucugaugaggnnnnnnnnccgaaacacauca

SEQ ID NO: 7945 - RNA, 38 nt, Artificial Sequence
  Description of Artificial Sequence:  Enzymatic Nucleic Acid
  misc_feature (18)..(25): n stands for any nucleotide and can be optionally absent
cuugcauacugaugaggnnnnnnnnccgaaauuacaca

SEQ ID NO: 7946 - RNA, 38 nt, Artificial Sequence
  Description of Artificial Sequence:  Enzymatic Nucleic Acid
  misc_feature (18)..(25): n stands for any nucleotide and can be optionally absent
gcuugcaucugaugaggnnnnnnnnccgaaaauuacac

SEQ ID NO: 7947 - RNA, 38 nt, Artificial Sequence
  Description of Artificial Sequence:  Enzymatic Nucleic Acid
  misc_feature (18)..(25): n stands for any nucleotide and can be optionally absent
agcuugcacugaugaggnnnnnnnnccgaaaaauuaca

SEQ ID NO: 7948 - RNA, 38 nt, Artificial Sequence
  Description of Artificial Sequence:  Enzymatic Nucleic Acid
  misc_feature (18)..(25): n stands for any nucleotide and can be optionally absent
uggagaggcugaugaggnnnnnnnnccgaaagcuugca

SEQ ID NO: 7949 - RNA, 38 nt, Artificial Sequence
  Description of Artificial Sequence:  Enzymatic Nucleic Acid
  misc_feature (18)..(25): n stands for any nucleotide and can be optionally absent
uagcuggacugaugaggnnnnnnnnccgaaagggagcu

SEQ ID NO: 7950 - RNA, 38 nt, Artificial Sequence
  Description of Artificial Sequence:  Enzymatic Nucleic Acid
  misc_feature (18)..(25): n stands for any nucleotide and can be optionally absent
ccuagcugcugaugaggnnnnnnnnccgaaagagggag

SEQ ID NO: 7951 - RNA, 38 nt, Artificial Sequence
  Description of Artificial Sequence:  Enzymatic Nucleic Acid
  misc_feature (18)..(25): n stands for any nucleotide and can be optionally absent
cugagucccugaugaggnnnnnnnnccgaaagcuggag

SEQ ID NO: 7952 - RNA, 38 nt, Artificial Sequence
  Description of Artificial Sequence:  Enzymatic Nucleic Acid
  misc_feature (18)..(25): n stands for any nucleotide and can be optionally absent
aauauccucugaugaggnnnnnnnnccgaaaguccuag

SEQ ID NO: 7953 - RNA, 38 nt, Artificial Sequence
  Description of Artificial Sequence:  Enzymatic Nucleic Acid
  misc_feature (18)..(25): n stands for any nucleotide and can be optionally absent
uugacuaacugaugaggnnnnnnnnccgaaauccugag

SEQ ID NO: 7954 - RNA, 38 nt, Artificial Sequence
  Description of Artificial Sequence:  Enzymatic Nucleic Acid
  misc_feature (18)..(25): n stands for any nucleotide and can be optionally absent
cauugacucugaugaggnnnnnnnnccgaaauauccug

SEQ ID NO: 7955 - RNA, 38 nt, Artificial Sequence
  Description of Artificial Sequence:  Enzymatic Nucleic Acid
  misc_feature (18)..(25): n stands for any nucleotide and can be optionally absent
ucauugaccugaugaggnnnnnnnnccgaaaauauccu

SEQ ID NO: 7956 - RNA, 38 nt, Artificial Sequence
  Description of Artificial Sequence:  Enzymatic Nucleic Acid
  misc_feature (18)..(25): n stands for any nucleotide and can be optionally absent
uuccuuuucugaugaggnnnnnnnnccgaaauggcuca

SEQ ID NO: 7957 - RNA, 38 nt, Artificial Sequence
  Description of Artificial Sequence:  Enzymatic Nucleic Acid
  misc_feature (18)..(25): n stands for any nucleotide and can be optionally absent
aaauaagacugaugaggnnnnnnnnccgaaagguuuuu

SEQ ID NO: 7958 - RNA, 38 nt, Artificial Sequence
  Description of Artificial Sequence:  Enzymatic Nucleic Acid
  misc_feature (18)..(25): n stands for any nucleotide and can be optionally absent
gaaaauaacugaugaggnnnnnnnnccgaaauagguuu

SEQ ID NO: 7959 - RNA, 38 nt, Artificial Sequence
  Description of Artificial Sequence:  Enzymatic Nucleic Acid
  misc_feature (18)..(25): n stands for any nucleotide and can be optionally absent
augaaaaucugaugaggnnnnnnnnccgaaagauaggu

SEQ ID NO: 7960 - RNA, 38 nt, Artificial Sequence
  Description of Artificial Sequence:  Enzymatic Nucleic Acid
  misc_feature (18)..(25): n stands for any nucleotide and can be optionally absent
gaugaaaacugaugaggnnnnnnnnccgaaaagauagg

SEQ ID NO: 7961 - RNA, 38 nt, Artificial Sequence
  Description of Artificial Sequence:  Enzymatic Nucleic Acid
  misc_feature (18)..(25): n stands for any nucleotide and can be optionally absent
cagaugaacugaugaggnnnnnnnnccgaaauaagaua

SEQ ID NO: 7962 - RNA, 38 nt, Artificial Sequence
  Description of Artificial Sequence:  Enzymatic Nucleic Acid
  misc_feature (18)..(25): n stands for any nucleotide and can be optionally absent
acagaugacugaugaggnnnnnnnnccgaaaauaagau

SEQ ID NO: 7963 - RNA, 38 nt, Artificial Sequence
  Description of Artificial Sequence:  Enzymatic Nucleic Acid
  misc_feature (18)..(25): n stands for any nucleotide and can be optionally absent
aacagaugcugaugaggnnnnnnnnccgaaaaauaaga

SEQ ID NO: 7964 - RNA, 38 nt, Artificial Sequence
  Description of Artificial Sequence:  Enzymatic Nucleic Acid
  misc_feature (18)..(25): n stands for any nucleotide and can be optionally absent
aaacagaucugaugaggnnnnnnnnccgaaaaaauaag

SEQ ID NO: 7965 - RNA, 38 nt, Artificial Sequence
  Description of Artificial Sequence:  Enzymatic Nucleic Acid
  misc_feature (18)..(25): n stands for any nucleotide and can be optionally absent
augaaacacugaugaggnnnnnnnnccgaaaugaaaau

SEQ ID NO: 7966 - RNA, 38 nt, Artificial Sequence
  Description of Artificial Sequence:  Enzymatic Nucleic Acid
  misc_feature (18)..(25): n stands for any nucleotide and can be optionally absent
agguaugacugaugaggnnnnnnnnccgaaacagauga

SEQ ID NO: 7967 - RNA, 38 nt, Artificial Sequence
  Description of Artificial Sequence:  Enzymatic Nucleic Acid
  misc_feature (18)..(25): n stands for any nucleotide and can be optionally absent
aagguaugcugaugaggnnnnnnnnccgaaaacagaug

SEQ ID NO: 7968 - RNA, 38 nt, Artificial Sequence
  Description of Artificial Sequence:  Enzymatic Nucleic Acid
  misc_feature (18)..(25): n stands for any nucleotide and can be optionally absent
caagguaucugaugaggnnnnnnnnccgaaaaacagau

SEQ ID NO: 7969 - RNA, 38 nt, Artificial Sequence
  Description of Artificial Sequence:  Enzymatic Nucleic Acid
  misc_feature (18)..(25): n stands for any nucleotide and can be optionally absent
agacaaggcugaugaggnnnnnnnnccgaaaugaaaca

SEQ ID NO: 7970 - RNA, 38 nt, Artificial Sequence
  Description of Artificial Sequence:  Enzymatic Nucleic Acid
  misc_feature (18)..(25): n stands for any nucleotide and can be optionally absent
ccccagaccugaugaggnnnnnnnnccgaaagguauga

SEQ ID NO: 7971 - RNA, 38 nt, Artificial Sequence
  Description of Artificial Sequence:  Enzymatic Nucleic Acid
  misc_feature (18)..(25): n stands for any nucleotide and can be optionally absent
agaccccacugaugaggnnnnnnnnccgaaacaaggua

SEQ ID NO: 7972 - RNA, 38 nt, Artificial Sequence
  Description of Artificial Sequence:  Enzymatic Nucleic Acid
  misc_feature (18)..(25): n stands for any nucleotide and can be optionally absent
cgucauuacugaugaggnnnnnnnnccgaaaccccaga

SEQ ID NO: 7973 - RNA, 38 nt, Artificial Sequence
  Description of Artificial Sequence:  Enzymatic Nucleic Acid
  misc_feature (18)..(25): n stands for any nucleotide and can be optionally absent
aucgucaucugaugaggnnnnnnnnccgaaagacccca

SEQ ID NO: 7974 - RNA, 38 nt, Artificial Sequence
  Description of Artificial Sequence:  Enzymatic Nucleic Acid
  misc_feature (18)..(25): n stands for any nucleotide and can be optionally absent
cccauguccugaugaggnnnnnnnnccgaaacccuguu

SEQ ID NO: 7975 - RNA, 38 nt, Artificial Sequence
  Description of Artificial Sequence:  Enzymatic Nucleic Acid
  misc_feature (18)..(25): n stands for any nucleotide and can be optionally absent
cccuuuuccugaugaggnnnnnnnnccgaaacccuguc

SEQ ID NO: 7976 - RNA, 38 nt, Artificial Sequence
  Description of Artificial Sequence:  Enzymatic Nucleic Acid
  misc_feature (18)..(25): n stands for any nucleotide and can be optionally absent
accccaaacugaugaggnnnnnnnnccgaaagcgggca

SEQ ID NO: 7977 - RNA, 38 nt, Artificial Sequence
  Description of Artificial Sequence:  Enzymatic Nucleic Acid
  misc_feature (18)..(25): n stands for any nucleotide and can be optionally absent
agaccccacugaugaggnnnnnnnnccgaaagagcggg

SEQ ID NO: 7978 - RNA, 38 nt, Artificial Sequence
  Description of Artificial Sequence:  Enzymatic Nucleic Acid
  misc_feature (18)..(25): n stands for any nucleotide and can be optionally absent
uagacccccugaugaggnnnnnnnnccgaaaagagcgg

SEQ ID NO: 7979 - RNA, 38 nt, Artificial Sequence
  Description of Artificial Sequence:  Enzymatic Nucleic Acid
  misc_feature (18)..(25): n stands for any nucleotide and can be optionally absent
caucucuacugaugaggnnnnnnnnccgaaaccccaaa

SEQ ID NO: 7980 - RNA, 38 nt, Artificial Sequence
  Description of Artificial Sequence:  Enzymatic Nucleic Acid
  misc_feature (18)..(25): n stands for any nucleotide and can be optionally absent
cucaucuccugaugaggnnnnnnnnccgaaagacccca

SEQ ID NO: 7981 - RNA, 38 nt, Artificial Sequence
  Description of Artificial Sequence:  Enzymatic Nucleic Acid
  misc_feature (18)..(25): n stands for any nucleotide and can be optionally absent
auuuuagacugaugaggnnnnnnnnccgaaacccaggg

SEQ ID NO: 7982 - RNA, 38 nt, Artificial Sequence
  Description of Artificial Sequence:  Enzymatic Nucleic Acid
  misc_feature (18)..(25): n stands for any nucleotide and can be optionally absent
ccauuuuacugaugaggnnnnnnnnccgaaagacccag

SEQ ID NO: 7983 - RNA, 38 nt, Artificial Sequence
  Description of Artificial Sequence:  Enzymatic Nucleic Acid
  misc_feature (18)..(25): n stands for any nucleotide and can be optionally absent
agccauuucugaugaggnnnnnnnnccgaaagagaccc

SEQ ID NO: 7984 - RNA, 38 nt, Artificial Sequence
  Description of Artificial Sequence:  Enzymatic Nucleic Acid
  misc_feature (18)..(25): n stands for any nucleotide and can be optionally absent
uucuaagacugaugaggnnnnnnnnccgaaagccauuu

SEQ ID NO: 7985 - RNA, 38 nt, Artificial Sequence
  Description of Artificial Sequence:  Enzymatic Nucleic Acid
  misc_feature (18)..(25): n stands for any nucleotide and can be optionally absent
acuucuaacugaugaggnnnnnnnnccgaaagagccau

SEQ ID NO: 7986 - RNA, 38 nt, Artificial Sequence
  Description of Artificial Sequence:  Enzymatic Nucleic Acid
  misc_feature (18)..(25): n stands for any nucleotide and can be optionally absent
caacuucucugaugaggnnnnnnnnccgaaagagagcc

SEQ ID NO: 7987 - RNA, 38 nt, Artificial Sequence
  Description of Artificial Sequence:  Enzymatic Nucleic Acid
  misc_feature (18)..(25): n stands for any nucleotide and can be optionally absent
acaacuuccugaugaggnnnnnnnnccgaaaagagagc

SEQ ID NO: 7988 - RNA, 38 nt, Artificial Sequence
  Description of Artificial Sequence:  Enzymatic Nucleic Acid
  misc_feature (18)..(25): n stands for any nucleotide and can be optionally absent
gcacauaccugaugaggnnnnnnnnccgaaacuucuaa

SEQ ID NO: 7989 - RNA, 38 nt, Artificial Sequence
  Description of Artificial Sequence:  Enzymatic Nucleic Acid
  misc_feature (18)..(25): n stands for any nucleotide and can be optionally absent
uuugcacacugaugaggnnnnnnnnccgaaacaacuuc

SEQ ID NO: 7990 - RNA, 38 nt, Artificial Sequence
  Description of Artificial Sequence:  Enzymatic Nucleic Acid
  misc_feature (18)..(25): n stands for any nucleotide and can be optionally absent
cagaccaucugaugaggnnnnnnnnccgaaauuugcac

SEQ ID NO: 7991 - RNA, 38 nt, Artificial Sequence
  Description of Artificial Sequence:  Enzymatic Nucleic Acid
  misc_feature (18)..(25): n stands for any nucleotide and can be optionally absent
acagaccacugaugaggnnnnnnnnccgaaaauuugca

SEQ ID NO: 7992 - RNA, 38 nt, Artificial Sequence
  Description of Artificial Sequence:  Enzymatic Nucleic Acid
  misc_feature (18)..(25): n stands for any nucleotide and can be optionally absent
agcacacacugaugaggnnnnnnnnccgaaaccauaau

SEQ ID NO: 7993 - RNA, 38 nt, Artificial Sequence
  Description of Artificial Sequence:  Enzymatic Nucleic Acid
  misc_feature (18)..(25): n stands for any nucleotide and can be optionally absent
cacgaccucugaugaggnnnnnnnnccgaaagcacaca

SEQ ID NO: 7994 - RNA, 38 nt, Artificial Sequence
  Description of Artificial Sequence:  Enzymatic Nucleic Acid
  misc_feature (18)..(25): n stands for any nucleotide and can be optionally absent
gcacgacccugaugaggnnnnnnnnccgaaaagcacac

SEQ ID NO: 7995 - RNA, 38 nt, Artificial Sequence
  Description of Artificial Sequence:  Enzymatic Nucleic Acid
  misc_feature (18)..(25): n stands for any nucleotide and can be optionally absent
gugugcaccugaugaggnnnnnnnnccgaaaccuaagc

SEQ ID NO: 7996 - RNA, 38 nt, Artificial Sequence
  Description of Artificial Sequence:  Enzymatic Nucleic Acid
  misc_feature (18)..(25): n stands for any nucleotide and can be optionally absent
ccagcugucugaugaggnnnnnnnnccgaaaccggcuc

SEQ ID NO: 7997 - RNA, 38 nt, Artificial Sequence
  Description of Artificial Sequence:  Enzymatic Nucleic Acid
  misc_feature (18)..(25): n stands for any nucleotide and can be optionally absent
aaagcagccugaugaggnnnnnnnnccgaaauucaucg

SEQ ID NO: 7998 - RNA, 38 nt, Artificial Sequence
  Description of Artificial Sequence:  Enzymatic Nucleic Acid
  misc_feature (18)..(25): n stands for any nucleotide and can be optionally absent
cucucccacugaugaggnnnnnnnnccgaaagcagcua

SEQ ID NO: 7999 - RNA, 38 nt, Artificial Sequence
  Description of Artificial Sequence:  Enzymatic Nucleic Acid
  misc_feature (18)..(25): n stands for any nucleotide and can be optionally absent
gcucuccccugaugaggnnnnnnnnccgaaaagcagcu

SEQ ID NO: 8000 - RNA, 38 nt, Artificial Sequence
  Description of Artificial Sequence:  Enzymatic Nucleic Acid
  misc_feature (18)..(25): n stands for any nucleotide and can be optionally absent
uaaguggccugaugaggnnnnnnnnccgaaagcaugcu

SEQ ID NO: 8001 - RNA, 38 nt, Artificial Sequence
  Description of Artificial Sequence:  Enzymatic Nucleic Acid
  misc_feature (18)..(25): n stands for any nucleotide and can be optionally absent
agagaauucugaugaggnnnnnnnnccgaaaguggcua

SEQ ID NO: 8002 - RNA, 38 nt, Artificial Sequence
  Description of Artificial Sequence:  Enzymatic Nucleic Acid
  misc_feature (18)..(25): n stands for any nucleotide and can be optionally absent
cagagaaucugaugaggnnnnnnnnccgaaaaguggcu

SEQ ID NO: 8003 - RNA, 38 nt, Artificial Sequence
  Description of Artificial Sequence:  Enzymatic Nucleic Acid
  misc_feature (18)..(25): n stands for any nucleotide and can be optionally absent
ggucagagcugaugaggnnnnnnnnccgaaauuaagug

SEQ ID NO: 8004 - RNA, 38 nt, Artificial Sequence
  Description of Artificial Sequence:  Enzymatic Nucleic Acid
  misc_feature (18)..(25): n stands for any nucleotide and can be optionally absent
cggucagacugaugaggnnnnnnnnccgaaaauuaagu

SEQ ID NO: 8005 - RNA, 38 nt, Artificial Sequence
  Description of Artificial Sequence:  Enzymatic Nucleic Acid
  misc_feature (18)..(25): n stands for any nucleotide and can be optionally absent
cccggucacugaugaggnnnnnnnnccgaaagaauuaa

SEQ ID NO: 8006 - RNA, 38 nt, Artificial Sequence
  Description of Artificial Sequence:  Enzymatic Nucleic Acid
  misc_feature (18)..(25): n stands for any nucleotide and can be optionally absent
guacccaucugaugaggnnnnnnnnccgaaaugcuggc

SEQ ID NO: 8007 - RNA, 38 nt, Artificial Sequence
  Description of Artificial Sequence:  Enzymatic Nucleic Acid
  misc_feature (18)..(25): n stands for any nucleotide and can be optionally absent
ggagcaggcugaugaggnnnnnnnnccgaaacccauga

SEQ ID NO: 8008 - RNA, 38 nt, Artificial Sequence
  Description of Artificial Sequence:  Enzymatic Nucleic Acid
  misc_feature (18)..(25): n stands for any nucleotide and can be optionally absent
acacagggcugaugaggnnnnnnnnccgaaagcaggua

SEQ ID NO: 8009 - RNA, 38 nt, Artificial Sequence
  Description of Artificial Sequence:  Enzymatic Nucleic Acid
  misc_feature (18)..(25): n stands for any nucleotide and can be optionally absent
ggauggggcugaugaggnnnnnnnnccgaaacacaggg

SEQ ID NO: 8010 - RNA, 38 nt, Artificial Sequence
  Description of Artificial Sequence:  Enzymatic Nucleic Acid
  misc_feature (18)..(25): n stands for any nucleotide and can be optionally absent
accuuaagcugaugaggnnnnnnnnccgaaauggggua

SEQ ID NO: 8011 - RNA, 38 nt, Artificial Sequence
  Description of Artificial Sequence:  Enzymatic Nucleic Acid
  misc_feature (18)..(25): n stands for any nucleotide and can be optionally absent
aaaaccuucugaugaggnnnnnnnnccgaaaggauggg

SEQ ID NO: 8012 - RNA, 38 nt, Artificial Sequence
  Description of Artificial Sequence:  Enzymatic Nucleic Acid
  misc_feature (18)..(25): n stands for any nucleotide and can be optionally absent
gaaaaccucugaugaggnnnnnnnnccgaaaaggaugg

SEQ ID NO: 8013 - RNA, 38 nt, Artificial Sequence
  Description of Artificial Sequence:  Enzymatic Nucleic Acid
  misc_feature (18)..(25): n stands for any nucleotide and can be optionally absent
agacagaacugaugaggnnnnnnnnccgaaaccuuaag

SEQ ID NO: 8014 - RNA, 38 nt, Artificial Sequence
  Description of Artificial Sequence:  Enzymatic Nucleic Acid
  misc_feature (18)..(25): n stands for any nucleotide and can be optionally absent
cagacagacugaugaggnnnnnnnnccgaaaaccuuaa

SEQ ID NO: 8015 - RNA, 38 nt, Artificial Sequence
  Description of Artificial Sequence:  Enzymatic Nucleic Acid
  misc_feature (18)..(25): n stands for any nucleotide and can be optionally absent
ucagacagcugaugaggnnnnnnnnccgaaaaaccuua

SEQ ID NO: 8016 - RNA, 38 nt, Artificial Sequence
  Description of Artificial Sequence:  Enzymatic Nucleic Acid
  misc_feature (18)..(25): n stands for any nucleotide and can be optionally absent
aucagacacugaugaggnnnnnnnnccgaaaaaaccuu

SEQ ID NO: 8017 - RNA, 38 nt, Artificial Sequence
  Description of Artificial Sequence:  Enzymatic Nucleic Acid
  misc_feature (18)..(25): n stands for any nucleotide and can be optionally absent
ucucaucacugaugaggnnnnnnnnccgaaacagaaaa

SEQ ID NO: 8018 - RNA, 38 nt, Artificial Sequence
  Description of Artificial Sequence:  Enzymatic Nucleic Acid
  misc_feature (18)..(25): n stands for any nucleotide and can be optionally absent
ucagugggcugaugaggnnnnnnnnccgaaauugcacu

SEQ ID NO: 8019 - RNA, 38 nt, Artificial Sequence
  Description of Artificial Sequence:  Enzymatic Nucleic Acid
  misc_feature (18)..(25): n stands for any nucleotide and can be optionally absent
ugcaccaacugaugaggnnnnnnnnccgaaagccacag

SEQ ID NO: 8020 - RNA, 38 nt, Artificial Sequence
  Description of Artificial Sequence:  Enzymatic Nucleic Acid
  misc_feature (18)..(25): n stands for any nucleotide and can be optionally absent
agugcacccugaugaggnnnnnnnnccgaaagagccac

SEQ ID NO: 8021 - RNA, 38 nt, Artificial Sequence
  Description of Artificial Sequence:  Enzymatic Nucleic Acid
  misc_feature (18)..(25): n stands for any nucleotide and can be optionally absent
uggcuggucugaugaggnnnnnnnnccgaaagugcacc

SEQ ID NO: 8022 - RNA, 38 nt, Artificial Sequence
  Description of Artificial Sequence:  Enzymatic Nucleic Acid
  misc_feature (18)..(25): n stands for any nucleotide and can be optionally absent
uacuuguccugaugaggnnnnnnnnccgaaaguccugg

SEQ ID NO: 8023 - RNA, 38 nt, Artificial Sequence
  Description of Artificial Sequence:  Enzymatic Nucleic Acid
  misc_feature (18)..(25): n stands for any nucleotide and can be optionally absent
cccuuucccugaugaggnnnnnnnnccgaaacuugucu

SEQ ID NO: 8024 - RNA, 38 nt, Artificial Sequence
  Description of Artificial Sequence:  Enzymatic Nucleic Acid
  misc_feature (18)..(25): n stands for any nucleotide and can be optionally absent
guggcuagcugaugaggnnnnnnnnccgaaagcccuuu

SEQ ID NO: 8025 - RNA, 38 nt, Artificial Sequence
  Description of Artificial Sequence:  Enzymatic Nucleic Acid
  misc_feature (18)..(25): n stands for any nucleotide and can be optionally absent
uguggcuacugaugaggnnnnnnnnccgaaaagcccuu

SEQ ID NO: 8026 - RNA, 38 nt, Artificial Sequence
  Description of Artificial Sequence:  Enzymatic Nucleic Acid
  misc_feature (18)..(25): n stands for any nucleotide and can be optionally absent
aguguggccugaugaggnnnnnnnnccgaaagaagccc

SEQ ID NO: 8027 - RNA, 38 nt, Artificial Sequence
  Description of Artificial Sequence:  Enzymatic Nucleic Acid
  misc_feature (18)..(25): n stands for any nucleotide and can be optionally absent
cccuaccucugaugaggnnnnnnnnccgaaauuuucuu

SEQ ID NO: 8028 - RNA, 38 nt, Artificial Sequence
  Description of Artificial Sequence:  Enzymatic Nucleic Acid
  misc_feature (18)..(25): n stands for any nucleotide and can be optionally absent
gccagccccugaugaggnnnnnnnnccgaaaccugauu

SEQ ID NO: 8029 - RNA, 38 nt, Artificial Sequence
  Description of Artificial Sequence:  Enzymatic Nucleic Acid
  misc_feature (18)..(25): n stands for any nucleotide and can be optionally absent
uggacaaacugaugaggnnnnnnnnccgaaaugucuuu

SEQ ID NO: 8030 - RNA, 38 nt, Artificial Sequence
  Description of Artificial Sequence:  Enzymatic Nucleic Acid
  misc_feature (18)..(25): n stands for any nucleotide and can be optionally absent
aauggacacugaugaggnnnnnnnnccgaaagaugucu

SEQ ID NO: 8031 - RNA, 38 nt, Artificial Sequence
  Description of Artificial Sequence:  Enzymatic Nucleic Acid
  misc_feature (18)..(25): n stands for any nucleotide and can be optionally absent
gaauggaccugaugaggnnnnnnnnccgaaaagauguc

SEQ ID NO: 8032 - RNA, 38 nt, Artificial Sequence
  Description of Artificial Sequence:  Enzymatic Nucleic Acid
  misc_feature (18)..(25): n stands for any nucleotide and can be optionally absent
ugcgaaugcugaugaggnnnnnnnnccgaaacaaagau

SEQ ID NO: 8033 - RNA, 38 nt, Artificial Sequence
  Description of Artificial Sequence:  Enzymatic Nucleic Acid
  misc_feature (18)..(25): n stands for any nucleotide and can be optionally absent
cuuuugcgcugaugaggnnnnnnnnccgaaauggacaa

SEQ ID NO: 8034 - RNA, 38 nt, Artificial Sequence
  Description of Artificial Sequence:  Enzymatic Nucleic Acid
  misc_feature (18)..(25): n stands for any nucleotide and can be optionally absent
gcuuuugccugaugaggnnnnnnnnccgaaaauggaca

SEQ ID NO: 8035 - RNA, 38 nt, Artificial Sequence
  Description of Artificial Sequence:  Enzymatic Nucleic Acid
  misc_feature (18)..(25): n stands for any nucleotide and can be optionally absent
gccgacaacugaugaggnnnnnnnnccgaaagcuuuug

SEQ ID NO: 8036 - RNA, 38 nt, Artificial Sequence
  Description of Artificial Sequence:  Enzymatic Nucleic Acid
  misc_feature (18)..(25): n stands for any nucleotide and can be optionally absent
cagccgaccugaugaggnnnnnnnnccgaaagagcuuu

SEQ ID NO: 8037 - RNA, 38 nt, Artificial Sequence
  Description of Artificial Sequence:  Enzymatic Nucleic Acid
  misc_feature (18)..(25): n stands for any nucleotide and can be optionally absent
cugcagcccugaugaggnnnnnnnnccgaaacaagagc

SEQ ID NO: 8038 - RNA, 38 nt, Artificial Sequence
  Description of Artificial Sequence:  Enzymatic Nucleic Acid
  misc_feature (18)..(25): n stands for any nucleotide and can be optionally absent
gccugacucugaugaggnnnnnnnnccgaaacacacug

SEQ ID NO: 8039 - RNA, 38 nt, Artificial Sequence
  Description of Artificial Sequence:  Enzymatic Nucleic Acid
  misc_feature (18)..(25): n stands for any nucleotide and can be optionally absent
caucgccucugaugaggnnnnnnnnccgaaacuuacac

SEQ ID NO: 8040 - RNA, 38 nt, Artificial Sequence
  Description of Artificial Sequence:  Enzymatic Nucleic Acid
  misc_feature (18)..(25): n stands for any nucleotide and can be optionally absent
uucucuggcugaugaggnnnnnnnnccgaaagccucug

SEQ ID NO: 8041 - RNA, 38 nt, Artificial Sequence
  Description of Artificial Sequence:  Enzymatic Nucleic Acid
  misc_feature (18)..(25): n stands for any nucleotide and can be optionally absent
ggaugagacugaugaggnnnnnnnnccgaaaccucagg

SEQ ID NO: 8042 - RNA, 38 nt, Artificial Sequence
  Description of Artificial Sequence:  Enzymatic Nucleic Acid
  misc_feature (18)..(25): n stands for any nucleotide and can be optionally absent
uggaugagcugaugaggnnnnnnnnccgaaaaccucag

SEQ ID NO: 8043 - RNA, 38 nt, Artificial Sequence
  Description of Artificial Sequence:  Enzymatic Nucleic Acid
  misc_feature (18)..(25): n stands for any nucleotide and can be optionally absent
cuggaugacugaugaggnnnnnnnnccgaaaaaccuca

SEQ ID NO: 8044 - RNA, 38 nt, Artificial Sequence
  Description of Artificial Sequence:  Enzymatic Nucleic Acid
  misc_feature (18)..(25): n stands for any nucleotide and can be optionally absent
aucuggaucugaugaggnnnnnnnnccgaaagaaaccu

SEQ ID NO: 8045 - RNA, 38 nt, Artificial Sequence
  Description of Artificial Sequence:  Enzymatic Nucleic Acid
  misc_feature (18)..(25): n stands for any nucleotide and can be optionally absent
gauaucugcugaugaggnnnnnnnnccgaaaugagaaa

SEQ ID NO: 8046 - RNA, 38 nt, Artificial Sequence
  Description of Artificial Sequence:  Enzymatic Nucleic Acid
  misc_feature (18)..(25): n stands for any nucleotide and can be optionally absent
uugcuggacugaugaggnnnnnnnnccgaaaucuggau

SEQ ID NO: 8047 - RNA, 38 nt, Artificial Sequence
  Description of Artificial Sequence:  Enzymatic Nucleic Acid
  misc_feature (18)..(25): n stands for any nucleotide and can be optionally absent
aauugcugcugaugaggnnnnnnnnccgaaauaucugg

SEQ ID NO: 8048 - RNA, 38 nt, Artificial Sequence
  Description of Artificial Sequence:  Enzymatic Nucleic Acid
  misc_feature (18)..(25): n stands for any nucleotide and can be optionally absent
cacccccccugaugaggnnnnnnnnccgaaauugcugg

SEQ ID NO: 8049 - RNA, 38 nt, Artificial Sequence
  Description of Artificial Sequence:  Enzymatic Nucleic Acid
  misc_feature (18)..(25): n stands for any nucleotide and can be optionally absent
ggaccauccugaugaggnnnnnnnnccgaaauggucuu

SEQ ID NO: 8050 - RNA, 38 nt, Artificial Sequence
  Description of Artificial Sequence:  Enzymatic Nucleic Acid
  misc_feature (18)..(25): n stands for any nucleotide and can be optionally absent
uaauacagcugaugaggnnnnnnnnccgaaaccaucua

SEQ ID NO: 8051 - RNA, 38 nt, Artificial Sequence
  Description of Artificial Sequence:  Enzymatic Nucleic Acid
  misc_feature (18)..(25): n stands for any nucleotide and can be optionally absent
cggaauaacugaugaggnnnnnnnnccgaaacaggacc

SEQ ID NO: 8052 - RNA, 38 nt, Artificial Sequence
  Description of Artificial Sequence:  Enzymatic Nucleic Acid
  misc_feature (18)..(25): n stands for any nucleotide and can be optionally absent
aucggaaucugaugaggnnnnnnnnccgaaauacagga

SEQ ID NO: 8053 - RNA, 38 nt, Artificial Sequence
  Description of Artificial Sequence:  Enzymatic Nucleic Acid
  misc_feature (18)..(25): n stands for any nucleotide and can be optionally absent
aaucggaacugaugaggnnnnnnnnccgaaaauacagg

SEQ ID NO: 8054 - RNA, 38 nt, Artificial Sequence
  Description of Artificial Sequence:  Enzymatic Nucleic Acid
  misc_feature (18)..(25): n stands for any nucleotide and can be optionally absent
aaaaucggcugaugaggnnnnnnnnccgaaauaauaca

SEQ ID NO: 8055 - RNA, 38 nt, Artificial Sequence
  Description of Artificial Sequence:  Enzymatic Nucleic Acid
  misc_feature (18)..(25): n stands for any nucleotide and can be optionally absent
uaaaaucgcugaugaggnnnnnnnnccgaaaauaauac

SEQ ID NO: 8056 - RNA, 38 nt, Artificial Sequence
  Description of Artificial Sequence:  Enzymatic Nucleic Acid
  misc_feature (18)..(25): n stands for any nucleotide and can be optionally absent
auuauuaacugaugaggnnnnnnnnccgaaaucggaau

SEQ ID NO: 8057 - RNA, 38 nt, Artificial Sequence
  Description of Artificial Sequence:  Enzymatic Nucleic Acid
  misc_feature (18)..(25): n stands for any nucleotide and can be optionally absent
gauuauuacugaugaggnnnnnnnnccgaaaaucggaa

SEQ ID NO: 8058 - RNA, 38 nt, Artificial Sequence
  Description of Artificial Sequence:  Enzymatic Nucleic Acid
  misc_feature (18)..(25): n stands for any nucleotide and can be optionally absent
agauuauucugaugaggnnnnnnnnccgaaaaaucgga

SEQ ID NO: 8059 - RNA, 38 nt, Artificial Sequence
  Description of Artificial Sequence:  Enzymatic Nucleic Acid
  misc_feature (18)..(25): n stands for any nucleotide and can be optionally absent
uagauuaucugaugaggnnnnnnnnccgaaaaaaucgg

SEQ ID NO: 8060 - RNA, 38 nt, Artificial Sequence
  Description of Artificial Sequence:  Enzymatic Nucleic Acid
  misc_feature (18)..(25): n stands for any nucleotide and can be optionally absent
aauuagaucugaugaggnnnnnnnnccgaaauuaaaau

SEQ ID NO: 8061 - RNA, 38 nt, Artificial Sequence
  Description of Artificial Sequence:  Enzymatic Nucleic Acid
  misc_feature (18)..(25): n stands for any nucleotide and can be optionally absent
acgaauuacugaugaggnnnnnnnnccgaaauuauuaa

SEQ ID NO: 8062 - RNA, 38 nt, Artificial Sequence
  Description of Artificial Sequence:  Enzymatic Nucleic Acid
  misc_feature (18)..(25): n stands for any nucleotide and can be optionally absent
ucacgaaucugaugaggnnnnnnnnccgaaagauuauu

SEQ ID NO: 8063 - RNA, 38 nt, Artificial Sequence
  Description of Artificial Sequence:  Enzymatic Nucleic Acid
  misc_feature (18)..(25): n stands for any nucleotide and can be optionally absent
ugaucacgcugaugaggnnnnnnnnccgaaauuagauu

SEQ ID NO: 8064 - RNA, 38 nt, Artificial Sequence
  Description of Artificial Sequence:  Enzymatic Nucleic Acid
  misc_feature (18)..(25): n stands for any nucleotide and can be optionally absent
augaucaccugaugaggnnnnnnnnccgaaaauuagau

SEQ ID NO: 8065 - RNA, 38 nt, Artificial Sequence
  Description of Artificial Sequence:  Enzymatic Nucleic Acid
  misc_feature (18)..(25): n stands for any nucleotide and can be optionally absent
cucuuaaucugaugaggnnnnnnnnccgaaaucacgaa

SEQ ID NO: 8066 - RNA, 38 nt, Artificial Sequence
  Description of Artificial Sequence:  Enzymatic Nucleic Acid
  misc_feature (18)..(25): n stands for any nucleotide and can be optionally absent
agucucuucugaugaggnnnnnnnnccgaaaugaucac

SEQ ID NO: 8067 - RNA, 38 nt, Artificial Sequence
  Description of Artificial Sequence:  Enzymatic Nucleic Acid
  misc_feature (18)..(25): n stands for any nucleotide and can be optionally absent
aagucucucugaugaggnnnnnnnnccgaaaaugauca

SEQ ID NO: 8068 - RNA, 38 nt, Artificial Sequence
  Description of Artificial Sequence:  Enzymatic Nucleic Acid
  misc_feature (18)..(25): n stands for any nucleotide and can be optionally absent
auuuacuacugaugaggnnnnnnnnccgaaagucucuu

SEQ ID NO: 8069 - RNA, 38 nt, Artificial Sequence
  Description of Artificial Sequence:  Enzymatic Nucleic Acid
  misc_feature (18)..(25): n stands for any nucleotide and can be optionally absent
cauuuacucugaugaggnnnnnnnnccgaaaagucucu

SEQ ID NO: 8070 - RNA, 38 nt, Artificial Sequence
  Description of Artificial Sequence:  Enzymatic Nucleic Acid
  misc_feature (18)..(25): n stands for any nucleotide and can be optionally absent
acauuuaccugaugaggnnnnnnnnccgaaaaagucuc

SEQ ID NO: 8071 - RNA, 38 nt, Artificial Sequence
  Description of Artificial Sequence:  Enzymatic Nucleic Acid
  misc_feature (18)..(25): n stands for any nucleotide and can be optionally absent
gggacauucugaugaggnnnnnnnnccgaaacuaaagu

SEQ ID NO: 8072 - RNA, 38 nt, Artificial Sequence
  Description of Artificial Sequence:  Enzymatic Nucleic Acid
  misc_feature (18)..(25): n stands for any nucleotide and can be optionally absent
ggaaaaggcugaugaggnnnnnnnnccgaaacauuuac

SEQ ID NO: 8073 - RNA, 38 nt, Artificial Sequence
  Description of Artificial Sequence:  Enzymatic Nucleic Acid
  misc_feature (18)..(25): n stands for any nucleotide and can be optionally absent
ugugggaacugaugaggnnnnnnnnccgaaagggacau

SEQ ID NO: 8074 - RNA, 38 nt, Artificial Sequence
  Description of Artificial Sequence:  Enzymatic Nucleic Acid
  misc_feature (18)..(25): n stands for any nucleotide and can be optionally absent
uugugggacugaugaggnnnnnnnnccgaaaagggaca

SEQ ID NO: 8075 - RNA, 38 nt, Artificial Sequence
  Description of Artificial Sequence:  Enzymatic Nucleic Acid
  misc_feature (18)..(25): n stands for any nucleotide and can be optionally absent
uuugugggcugaugaggnnnnnnnnccgaaaaagggac

SEQ ID NO: 8076 - RNA, 38 nt, Artificial Sequence
  Description of Artificial Sequence:  Enzymatic Nucleic Acid
  misc_feature (18)..(25): n stands for any nucleotide and can be optionally absent
uuuuguggcugaugaggnnnnnnnnccgaaaaaaggga

SEQ ID NO: 8077 - RNA, 38 nt, Artificial Sequence
  Description of Artificial Sequence:  Enzymatic Nucleic Acid
  misc_feature (18)..(25): n stands for any nucleotide and can be optionally absent
cuuuucuucugaugaggnnnnnnnnccgaaacuuuugu

SEQ ID NO: 8078 - RNA, 38 nt, Artificial Sequence
  Description of Artificial Sequence:  Enzymatic Nucleic Acid
  misc_feature (18)..(25): n stands for any nucleotide and can be optionally absent
aaucccgacugaugaggnnnnnnnnccgaaagcuuuuc

SEQ ID NO: 8079 - RNA, 38 nt, Artificial Sequence
  Description of Artificial Sequence:  Enzymatic Nucleic Acid
  misc_feature (18)..(25): n stands for any nucleotide and can be optionally absent
agaauccccugaugaggnnnnnnnnccgaaauagcuuu

SEQ ID NO: 8080 - RNA, 38 nt, Artificial Sequence
  Description of Artificial Sequence:  Enzymatic Nucleic Acid
  misc_feature (18)..(25): n stands for any nucleotide and can be optionally absent
aaccagagcugaugaggnnnnnnnnccgaaaucccgau

SEQ ID NO: 8081 - RNA, 38 nt, Artificial Sequence
  Description of Artificial Sequence:  Enzymatic Nucleic Acid
  misc_feature (18)..(25): n stands for any nucleotide and can be optionally absent
gaaccagacugaugaggnnnnnnnnccgaaaaucccga

SEQ ID NO: 8082 - RNA, 38 nt, Artificial Sequence
  Description of Artificial Sequence:  Enzymatic Nucleic Acid
  misc_feature (18)..(25): n stands for any nucleotide and can be optionally absent
cagaaccacugaugaggnnnnnnnnccgaaagaauccc

SEQ ID NO: 8083 - RNA, 38 nt, Artificial Sequence
  Description of Artificial Sequence:  Enzymatic Nucleic Acid
  misc_feature (18)..(25): n stands for any nucleotide and can be optionally absent
uuaagcagcugaugaggnnnnnnnnccgaaaccagaga

SEQ ID NO: 8084 - RNA, 38 nt, Artificial Sequence
  Description of Artificial Sequence:  Enzymatic Nucleic Acid
  misc_feature (18)..(25): n stands for any nucleotide and can be optionally absent
uuuaagcacugaugaggnnnnnnnnccgaaaaccagag

SEQ ID NO: 8085 - RNA, 38 nt, Artificial Sequence
  Description of Artificial Sequence:  Enzymatic Nucleic Acid
  misc_feature (18)..(25): n stands for any nucleotide and can be optionally absent
aagucuuucugaugaggnnnnnnnnccgaaagcagaac

SEQ ID NO: 8086 - RNA, 38 nt, Artificial Sequence
  Description of Artificial Sequence:  Enzymatic Nucleic Acid
  misc_feature (18)..(25): n stands for any nucleotide and can be optionally absent
uaagucuucugaugaggnnnnnnnnccgaaaagcagaa

SEQ ID NO: 8087 - RNA, 38 nt, Artificial Sequence
  Description of Artificial Sequence:  Enzymatic Nucleic Acid
  misc_feature (18)..(25): n stands for any nucleotide and can be optionally absent
ccaaagcucugaugaggnnnnnnnnccgaaagucuuua

SEQ ID NO: 8088 - RNA, 38 nt, Artificial Sequence
  Description of Artificial Sequence:  Enzymatic Nucleic Acid
  misc_feature (18)..(25): n stands for any nucleotide and can be optionally absent
uccaaagccugaugaggnnnnnnnnccgaaaagucuuu

SEQ ID NO: 8089 - RNA, 38 nt, Artificial Sequence
  Description of Artificial Sequence:  Enzymatic Nucleic Acid
  misc_feature (18)..(25): n stands for any nucleotide and can be optionally absent
aggcuccacugaugaggnnnnnnnnccgaaagcuaagu

SEQ ID NO: 8090 - RNA, 38 nt, Artificial Sequence
  Description of Artificial Sequence:  Enzymatic Nucleic Acid
  misc_feature (18)..(25): n stands for any nucleotide and can be optionally absent
uaggcucccugaugaggnnnnnnnnccgaaaagcuaag

SEQ ID NO: 8091 - RNA, 38 nt, Artificial Sequence
  Description of Artificial Sequence:  Enzymatic Nucleic Acid
  misc_feature (18)..(25): n stands for any nucleotide and can be optionally absent
aacuuucacugaugaggnnnnnnnnccgaaaggcucca

SEQ ID NO: 8092 - RNA, 38 nt, Artificial Sequence
  Description of Artificial Sequence:  Enzymatic Nucleic Acid
  misc_feature (18)..(25): n stands for any nucleotide and can be optionally absent
ggcugauccugaugaggnnnnnnnnccgaaacuuucau

SEQ ID NO: 8093 - RNA, 54 nt, Artificial Sequence
  Description of Artificial Sequence:  Enzymatic Nucleic Acid
gucccagcagaagaccauaccagagaaacacacguugugguacauuaccuggua

SEQ ID NO: 8094 - RNA, 54 nt, Artificial Sequence
  Description of Artificial Sequence:  Enzymatic Nucleic Acid
ggugucccagaagcugacaccagagaaacacacguugugguacauuaccuggua

SEQ ID NO: 8095 - RNA, 54 nt, Artificial Sequence
  Description of Artificial Sequence:  Enzymatic Nucleic Acid
uaaggcaaagaagcggugaccagagaaacacacguugugguacauuaccuggua

SEQ ID NO: 8096 - RNA, 54 nt, Artificial Sequence
  Description of Artificial Sequence:  Enzymatic Nucleic Acid
gacacccgagaagcgcguaccagagaaacacacguugugguacauuaccuggua

SEQ ID NO: 8097 - RNA, 54 nt, Artificial Sequence
  Description of Artificial Sequence:  Enzymatic Nucleic Acid
cugugagaagaagacaccaccagagaaacacacguugugguacauuaccuggua

SEQ ID NO: 8098 - RNA, 54 nt, Artificial Sequence
  Description of Artificial Sequence:  Enzymatic Nucleic Acid
gaaagagaagaaggccugaccagagaaacacacguugugguacauuaccuggua

SEQ ID NO: 8099 - RNA, 54 nt, Artificial Sequence
  Description of Artificial Sequence:  Enzymatic Nucleic Acid
caugagugagaagccuccaccagagaaacacacguugugguacauuaccuggua

SEQ ID NO: 8100 - RNA, 54 nt, Artificial Sequence
  Description of Artificial Sequence:  Enzymatic Nucleic Acid
cggucgugagaagagaccaccagagaaacacacguugugguacauuaccuggua

SEQ ID NO: 8101 - RNA, 54 nt, Artificial Sequence
  Description of Artificial Sequence:  Enzymatic Nucleic Acid
cucccacaagaagaugggaccagagaaacacacguugugguacauuaccuggua

SEQ ID NO: 8102 - RNA, 54 nt, Artificial Sequence
  Description of Artificial Sequence:  Enzymatic Nucleic Acid
ggaugaugagaagucuucaccagagaaacacacguugugguacauuaccuggua

SEQ ID NO: 8103 - RNA, 54 nt, Artificial Sequence
  Description of Artificial Sequence:  Enzymatic Nucleic Acid
cgucacccagaaggggauaccagagaaacacacguugugguacauuaccuggua

SEQ ID NO: 8104 - RNA, 54 nt, Artificial Sequence
  Description of Artificial Sequence:  Enzymatic Nucleic Acid
cuuugcccagaagggguaaccagagaaacacacguugugguacauuaccuggua

SEQ ID NO: 8105 - RNA, 54 nt, Artificial Sequence
  Description of Artificial Sequence:  Enzymatic Nucleic Acid
cgcaguucagaaguccuaaccagagaaacacacguugugguacauuaccuggua

SEQ ID NO: 8106 - RNA, 54 nt, Artificial Sequence
  Description of Artificial Sequence:  Enzymatic Nucleic Acid
gccgauggagaagauaguaccagagaaacacacguugugguacauuaccuggua

SEQ ID NO: 8107 - RNA, 54 nt, Artificial Sequence
  Description of Artificial Sequence:  Enzymatic Nucleic Acid
uuguauugagaagccgauaccagagaaacacacguugugguacauuaccuggua

SEQ ID NO: 8108 - RNA, 54 nt, Artificial Sequence
  Description of Artificial Sequence:  Enzymatic Nucleic Acid
cugggcucagaaggcguaaccagagaaacacacguugugguacauuaccuggua

SEQ ID NO: 8109 - RNA, 54 nt, Artificial Sequence
  Description of Artificial Sequence:  Enzymatic Nucleic Acid
gcccguggagaagucucaaccagagaaacacacguugugguacauuaccuggua

SEQ ID NO: 8110 - RNA, 54 nt, Artificial Sequence
  Description of Artificial Sequence:  Enzymatic Nucleic Acid
ggacaagaagaagcccguaccagagaaacacacguugugguacauuaccuggua

SEQ ID NO: 8111 - RNA, 54 nt, Artificial Sequence
  Description of Artificial Sequence:  Enzymatic Nucleic Acid
uccggucaagaagcugccaccagagaaacacacguugugguacauuaccuggua

SEQ ID NO: 8112 - RNA, 54 nt, Artificial Sequence
  Description of Artificial Sequence:  Enzymatic Nucleic Acid
cuucacgcagaagguguaaccagagaaacacacguugugguacauuaccuggua

SEQ ID NO: 8113 - RNA, 54 nt, Artificial Sequence
  Description of Artificial Sequence:  Enzymatic Nucleic Acid
uguugaaaagaaggaacgaccagagaaacacacguugugguacauuaccuggua

SEQ ID NO: 8114 - RNA, 54 nt, Artificial Sequence
  Description of Artificial Sequence:  Enzymatic Nucleic Acid
ccugcaccagaagcuuccaccagagaaacacacguugugguacauuaccuggua

SEQ ID NO: 8115 - RNA, 54 nt, Artificial Sequence
  Description of Artificial Sequence:  Enzymatic Nucleic Acid
gccgauagagaagucuucaccagagaaacacacguugugguacauuaccuggua

SEQ ID NO: 8116 - RNA, 54 nt, Artificial Sequence
  Description of Artificial Sequence:  Enzymatic Nucleic Acid
ucauggacagaagauaggaccagagaaacacacguugugguacauuaccuggua

SEQ ID NO: 8117 - RNA, 54 nt, Artificial Sequence
  Description of Artificial Sequence:  Enzymatic Nucleic Acid
cuuucaugagaagccgauaccagagaaacacacguugugguacauuaccuggua

SEQ ID NO: 8118 - RNA, 54 nt, Artificial Sequence
  Description of Artificial Sequence:  Enzymatic Nucleic Acid
aaauagcgagaagacuucaccagagaaacacacguugugguacauuaccuggua

SEQ ID NO: 8119 - RNA, 54 nt, Artificial Sequence
  Description of Artificial Sequence:  Enzymatic Nucleic Acid
uuucguagagaagagguuaccagagaaacacacguugugguacauuaccuggua

SEQ ID NO: 8120 - RNA, 54 nt, Artificial Sequence
  Description of Artificial Sequence:  Enzymatic Nucleic Acid
ugcugcccagaagauagaaccagagaaacacacguugugguacauuaccuggua

SEQ ID NO: 8121 - RNA, 54 nt, Artificial Sequence
  Description of Artificial Sequence:  Enzymatic Nucleic Acid
gucugagaagaagccaccaccagagaaacacacguugugguacauuaccuggua

SEQ ID NO: 8122 - RNA, 54 nt, Artificial Sequence
  Description of Artificial Sequence:  Enzymatic Nucleic Acid
uuccagggagaagagaguaccagagaaacacacguugugguacauuaccuggua

SEQ ID NO: 8123 - RNA, 54 nt, Artificial Sequence
  Description of Artificial Sequence:  Enzymatic Nucleic Acid
ggcccggcagaaguagauaccagagaaacacacguugugguacauuaccuggua

SEQ ID NO: 8124 - RNA, 54 nt, Artificial Sequence
  Description of Artificial Sequence:  Enzymatic Nucleic Acid
gaaggcccagaagcuguaaccagagaaacacacguugugguacauuaccuggua

SEQ ID NO: 8125 - RNA, 54 nt, Artificial Sequence
  Description of Artificial Sequence:  Enzymatic Nucleic Acid
uucggcacagaagugacaaccagagaaacacacguugugguacauuaccuggua

SEQ ID NO: 8126 - RNA, 54 nt, Artificial Sequence
  Description of Artificial Sequence:  Enzymatic Nucleic Acid
ucuccuucagaaggcaucaccagagaaacacacguugugguacauuaccuggua

SEQ ID NO: 8127 - RNA, 54 nt, Artificial Sequence
  Description of Artificial Sequence:  Enzymatic Nucleic Acid
ccacacagagaaguuucaaccagagaaacacacguugugguacauuaccuggua

SEQ ID NO: 8128 - RNA, 54 nt, Artificial Sequence
  Description of Artificial Sequence:  Enzymatic Nucleic Acid
gguuuugaagaaggugugaccagagaaacacacguugugguacauuaccuggua

SEQ ID NO: 8129 - RNA, 54 nt, Artificial Sequence
  Description of Artificial Sequence:  Enzymatic Nucleic Acid
accaagugagaagaggcgaccagagaaacacacguugugguacauuaccuggua

SEQ ID NO: 8130 - RNA, 54 nt, Artificial Sequence
  Description of Artificial Sequence:  Enzymatic Nucleic Acid
gugagguaagaagcgcuuaccagagaaacacacguugugguacauuaccuggua

SEQ ID NO: 8131 - RNA, 54 nt, Artificial Sequence
  Description of Artificial Sequence:  Enzymatic Nucleic Acid
ugagcgugagaagcuccaaccagagaaacacacguugugguacauuaccuggua

SEQ ID NO: 8132 - RNA, 54 nt, Artificial Sequence
  Description of Artificial Sequence:  Enzymatic Nucleic Acid
cggaagaaagaagcuucaaccagagaaacacacguugugguacauuaccuggua

SEQ ID NO: 8133 - RNA, 54 nt, Artificial Sequence
  Description of Artificial Sequence:  Enzymatic Nucleic Acid
gacagguaagaagucuuuaccagagaaacacacguugugguacauuaccuggua

SEQ ID NO: 8134 - RNA, 54 nt, Artificial Sequence
  Description of Artificial Sequence:  Enzymatic Nucleic Acid
cauagggcagaaguucacaccagagaaacacacguugugguacauuaccuggua

SEQ ID NO: 8135 - RNA, 54 nt, Artificial Sequence
  Description of Artificial Sequence:  Enzymatic Nucleic Acid
caucauagagaagccguuaccagagaaacacacguugugguacauuaccuggua

SEQ ID NO: 8136 - RNA, 54 nt, Artificial Sequence
  Description of Artificial Sequence:  Enzymatic Nucleic Acid
cacaguccagaaggugggaccagagaaacacacguugugguacauuaccuggua

SEQ ID NO: 8137 - RNA, 54 nt, Artificial Sequence
  Description of Artificial Sequence:  Enzymatic Nucleic Acid
cagccacaagaaggcaggaccagagaaacacacguugugguacauuaccuggua

SEQ ID NO: 8138 - RNA, 54 nt, Artificial Sequence
  Description of Artificial Sequence:  Enzymatic Nucleic Acid
guucggucagaagagcuuaccagagaaacacacguugugguacauuaccuggua

SEQ ID NO: 8139 - RNA, 54 nt, Artificial Sequence
  Description of Artificial Sequence:  Enzymatic Nucleic Acid
cgaucaccagaagaggccaccagagaaacacacguugugguacauuaccuggua

SEQ ID NO: 8140 - RNA, 54 nt, Artificial Sequence
  Description of Artificial Sequence:  Enzymatic Nucleic Acid
gguaguugagaagguuucaccagagaaacacacguugugguacauuaccuggua

SEQ ID NO: 8141 - RNA, 54 nt, Artificial Sequence
  Description of Artificial Sequence:  Enzymatic Nucleic Acid
cuuguugaagaagaauaaaccagagaaacacacguugugguacauuaccuggua

SEQ ID NO: 8142 - RNA, 54 nt, Artificial Sequence
  Description of Artificial Sequence:  Enzymatic Nucleic Acid
auaugcaaagaagcguccaccagagaaacacacguugugguacauuaccuggua

SEQ ID NO: 8143 - RNA, 54 nt, Artificial Sequence
  Description of Artificial Sequence:  Enzymatic Nucleic Acid
acugucuaagaagggcuuaccagagaaacacacguugugguacauuaccuggua

SEQ ID NO: 8144 - RNA, 54 nt, Artificial Sequence
  Description of Artificial Sequence:  Enzymatic Nucleic Acid
gacacuugagaagcugacaccagagaaacacacguugugguacauuaccuggua

SEQ ID NO: 8145 - RNA, 54 nt, Artificial Sequence
  Description of Artificial Sequence:  Enzymatic Nucleic Acid
gaagcuggagaaggugacaccagagaaacacacguugugguacauuaccuggua

SEQ ID NO: 8146 - RNA, 54 nt, Artificial Sequence
  Description of Artificial Sequence:  Enzymatic Nucleic Acid
uucagggaagaaggagcuaccagagaaacacacguugugguacauuaccuggua

SEQ ID NO: 8147 - RNA, 54 nt, Artificial Sequence
  Description of Artificial Sequence:  Enzymatic Nucleic Acid
uggugaggagaagcuuggaccagagaaacacacguugugguacauuaccuggua

SEQ ID NO: 8148 - RNA, 54 nt, Artificial Sequence
  Description of Artificial Sequence:  Enzymatic Nucleic Acid
uguaggaaagaaggucuuaccagagaaacacacguugugguacauuaccuggua

SEQ ID NO: 8149 - RNA, 54 nt, Artificial Sequence
  Description of Artificial Sequence:  Enzymatic Nucleic Acid
cacuuggaagaaguaggaaccagagaaacacacguugugguacauuaccuggua

SEQ ID NO: 8150 - RNA, 54 nt, Artificial Sequence
  Description of Artificial Sequence:  Enzymatic Nucleic Acid
uucuggagagaagaaacuaccagagaaacacacguugugguacauuaccuggua

SEQ ID NO: 8151 - RNA, 54 nt, Artificial Sequence
  Description of Artificial Sequence:  Enzymatic Nucleic Acid
cuucaggcagaagcagaaaccagagaaacacacguugugguacauuaccuggua

SEQ ID NO: 8152 - RNA, 54 nt, Artificial Sequence
  Description of Artificial Sequence:  Enzymatic Nucleic Acid
uuccuucaagaagcugcaaccagagaaacacacguugugguacauuaccuggua

SEQ ID NO: 8153 - RNA, 54 nt, Artificial Sequence
  Description of Artificial Sequence:  Enzymatic Nucleic Acid
ggguucucagaagcaugcaccagagaaacacacguugugguacauuaccuggua

SEQ ID NO: 8154 - RNA, 54 nt, Artificial Sequence
  Description of Artificial Sequence:  Enzymatic Nucleic Acid
guucagcaagaaggggccaccagagaaacacacguugugguacauuaccuggua

SEQ ID NO: 8155 - RNA, 54 nt, Artificial Sequence
  Description of Artificial Sequence:  Enzymatic Nucleic Acid
uggcuugaagaaggucacaccagagaaacacacguugugguacauuaccuggua

SEQ ID NO: 8156 - RNA, 54 nt, Artificial Sequence
  Description of Artificial Sequence:  Enzymatic Nucleic Acid
uguuucuaagaaguauggaccagagaaacacacguugugguacauuaccuggua

SEQ ID NO: 8157 - RNA, 54 nt, Artificial Sequence
  Description of Artificial Sequence:  Enzymatic Nucleic Acid
aucugcaaagaaguccuuaccagagaaacacacguugugguacauuaccuggua

SEQ ID NO: 8158 - RNA, 54 nt, Artificial Sequence
  Description of Artificial Sequence:  Enzymatic Nucleic Acid
aaauguggagaagcaaagaccagagaaacacacguugugguacauuaccuggua

SEQ ID NO: 8159 - RNA, 54 nt, Artificial Sequence
  Description of Artificial Sequence:  Enzymatic Nucleic Acid
cucacaucagaagagcuuaccagagaaacacacguugugguacauuaccuggua

SEQ ID NO: 8160 - RNA, 54 nt, Artificial Sequence
  Description of Artificial Sequence:  Enzymatic Nucleic Acid
uaguguccagaagauaguaccagagaaacacacguugugguacauuaccuggua

SEQ ID NO: 8161 - RNA, 54 nt, Artificial Sequence
  Description of Artificial Sequence:  Enzymatic Nucleic Acid
gggagcccagaagagugcaccagagaaacacacguugugguacauuaccuggua

SEQ ID NO: 8162 - RNA, 54 nt, Artificial Sequence
  Description of Artificial Sequence:  Enzymatic Nucleic Acid
uccaggugagaagcuucaaccagagaaacacacguugugguacauuaccuggua

SEQ ID NO: 8163 - RNA, 54 nt, Artificial Sequence
  Description of Artificial Sequence:  Enzymatic Nucleic Acid
cucggcagagaagaaaguaccagagaaacacacguugugguacauuaccuggua

SEQ ID NO: 8164 - RNA, 54 nt, Artificial Sequence
  Description of Artificial Sequence:  Enzymatic Nucleic Acid
ugggccucagaagaucggaccagagaaacacacguugugguacauuaccuggua

SEQ ID NO: 8165 - RNA, 54 nt, Artificial Sequence
  Description of Artificial Sequence:  Enzymatic Nucleic Acid
gaagcagaagaagggccuaccagagaaacacacguugugguacauuaccuggua

SEQ ID NO: 8166 - RNA, 54 nt, Artificial Sequence
  Description of Artificial Sequence:  Enzymatic Nucleic Acid
gcuggagaagaagaagcuaccagagaaacacacguugugguacauuaccuggua

SEQ ID NO: 8167 - RNA, 54 nt, Artificial Sequence
  Description of Artificial Sequence:  Enzymatic Nucleic Acid
guggccacagaaggagaaaccagagaaacacacguugugguacauuaccuggua

SEQ ID NO: 8168 - RNA, 54 nt, Artificial Sequence
  Description of Artificial Sequence:  Enzymatic Nucleic Acid
uggagaacagaaggacucaccagagaaacacacguugugguacauuaccuggua

SEQ ID NO: 8169 - RNA, 54 nt, Artificial Sequence
  Description of Artificial Sequence:  Enzymatic Nucleic Acid
ggguggagagaagcaggaaccagagaaacacacguugugguacauuaccuggua

SEQ ID NO: 8170 - RNA, 54 nt, Artificial Sequence
  Description of Artificial Sequence:  Enzymatic Nucleic Acid
gaguuguaagaaggggguaccagagaaacacacguugugguacauuaccuggua

SEQ ID NO: 8171 - RNA, 54 nt, Artificial Sequence
  Description of Artificial Sequence:  Enzymatic Nucleic Acid
uuuaggcgagaagggaggaccagagaaacacacguugugguacauuaccuggua

SEQ ID NO: 8172 - RNA, 54 nt, Artificial Sequence
  Description of Artificial Sequence:  Enzymatic Nucleic Acid
aagcuuuaagaaggcgggaccagagaaacacacguugugguacauuaccuggua

SEQ ID NO: 8173 - RNA, 54 nt, Artificial Sequence
  Description of Artificial Sequence:  Enzymatic Nucleic Acid
guugucggagaaggugagaccagagaaacacacguugugguacauuaccuggua

SEQ ID NO: 8174 - RNA, 54 nt, Artificial Sequence
  Description of Artificial Sequence:  Enzymatic Nucleic Acid
cugucaggagaagguuguaccagagaaacacacguugugguacauuaccuggua

SEQ ID NO: 8175 - RNA, 54 nt, Artificial Sequence
  Description of Artificial Sequence:  Enzymatic Nucleic Acid
uccuguggagaagaauagaccagagaaacacacguugugguacauuaccuggua

SEQ ID NO: 8176 - RNA, 54 nt, Artificial Sequence
  Description of Artificial Sequence:  Enzymatic Nucleic Acid
cgaaaagcagaaggcuccaccagagaaacacacguugugguacauuaccuggua

SEQ ID NO: 8177 - RNA, 54 nt, Artificial Sequence
  Description of Artificial Sequence:  Enzymatic Nucleic Acid
ucacgaaaagaagcuggcaccagagaaacacacguugugguacauuaccuggua

SEQ ID NO: 8178 - RNA, 54 nt, Artificial Sequence
  Description of Artificial Sequence:  Enzymatic Nucleic Acid
uuagucaaagaagcaacaaccagagaaacacacguugugguacauuaccuggua

SEQ ID NO: 8179 - RNA, 54 nt, Artificial Sequence
  Description of Artificial Sequence:  Enzymatic Nucleic Acid
ggugggcgagaagucgccaccagagaaacacacguugugguacauuaccuggua

SEQ ID NO: 8180 - RNA, 54 nt, Artificial Sequence
  Description of Artificial Sequence:  Enzymatic Nucleic Acid
ggccggugagaaggcgguaccagagaaacacacguugugguacauuaccuggua

SEQ ID NO: 8181 - RNA, 54 nt, Artificial Sequence
  Description of Artificial Sequence:  Enzymatic Nucleic Acid
agucccacagaagcagggaccagagaaacacacguugugguacauuaccuggua

SEQ ID NO: 8182 - RNA, 54 nt, Artificial Sequence
  Description of Artificial Sequence:  Enzymatic Nucleic Acid
cagagcagagaagugcauaccagagaaacacacguugugguacauuaccuggua

SEQ ID NO: 8183 - RNA, 54 nt, Artificial Sequence
  Description of Artificial Sequence:  Enzymatic Nucleic Acid
agagacagagaaggucagaccagagaaacacacguugugguacauuaccuggua

SEQ ID NO: 8184 - RNA, 54 nt, Artificial Sequence
  Description of Artificial Sequence:  Enzymatic Nucleic Acid
auaagagaagaagagcagaccagagaaacacacguugugguacauuaccuggua

SEQ ID NO: 8185 - RNA, 54 nt, Artificial Sequence
  Description of Artificial Sequence:  Enzymatic Nucleic Acid
cuccacagagaagacgcaaccagagaaacacacguugugguacauuaccuggua

SEQ ID NO: 8186 - RNA, 54 nt, Artificial Sequence
  Description of Artificial Sequence:  Enzymatic Nucleic Acid
cccgaaacagaagaggccaccagagaaacacacguugugguacauuaccuggua

SEQ ID NO: 8187 - RNA, 54 nt, Artificial Sequence
  Description of Artificial Sequence:  Enzymatic Nucleic Acid
gggcccgaagaagcggagaccagagaaacacacguugugguacauuaccuggua

SEQ ID NO: 8188 - RNA, 54 nt, Artificial Sequence
  Description of Artificial Sequence:  Enzymatic Nucleic Acid
aaacagacagaagaagacaccagagaaacacacguugugguacauuaccuggua

SEQ ID NO: 8189 - RNA, 54 nt, Artificial Sequence
  Description of Artificial Sequence:  Enzymatic Nucleic Acid
ggaugguaagaagacaacaccagagaaacacacguugugguacauuaccuggua

SEQ ID NO: 8190 - RNA, 54 nt, Artificial Sequence
  Description of Artificial Sequence:  Enzymatic Nucleic Acid
acuagaggagaagaugauaccagagaaacacacguugugguacauuaccuggua

SEQ ID NO: 8191 - RNA, 54 nt, Artificial Sequence
  Description of Artificial Sequence:  Enzymatic Nucleic Acid
augcgaagagaaggccugaccagagaaacacacguugugguacauuaccuggua

SEQ ID NO: 8192 - RNA, 54 nt, Artificial Sequence
  Description of Artificial Sequence:  Enzymatic Nucleic Acid
uccccgugagaaguaugcaccagagaaacacacguugugguacauuaccuggua

SEQ ID NO: 8193 - RNA, 54 nt, Artificial Sequence
  Description of Artificial Sequence:  Enzymatic Nucleic Acid
cuaggccaagaaggaccaaccagagaaacacacguugugguacauuaccuggua

SEQ ID NO: 8194 - RNA, 54 nt, Artificial Sequence
  Description of Artificial Sequence:  Enzymatic Nucleic Acid
uugagcccagaaguaggcaccagagaaacacacguugugguacauuaccuggua

SEQ ID NO: 8195 - RNA, 54 nt, Artificial Sequence
  Description of Artificial Sequence:  Enzymatic Nucleic Acid
auauauaaagaaggauaaaccagagaaacacacguugugguacauuaccuggua

SEQ ID NO: 8196 - RNA, 54 nt, Artificial Sequence
  Description of Artificial Sequence:  Enzymatic Nucleic Acid
uccucucaagaagccuugaccagagaaacacacguugugguacauuaccuggua

SEQ ID NO: 8197 - RNA, 54 nt, Artificial Sequence
  Description of Artificial Sequence:  Enzymatic Nucleic Acid
uaaauaugagaagauacuaccagagaaacacacguugugguacauuaccuggua

SEQ ID NO: 8198 - RNA, 54 nt, Artificial Sequence
  Description of Artificial Sequence:  Enzymatic Nucleic Acid
agguaugaagaagaugaaaccagagaaacacacguugugguacauuaccuggua

SEQ ID NO: 8199 - RNA, 54 nt, Artificial Sequence
  Description of Artificial Sequence:  Enzymatic Nucleic Acid
ccccaaagagaaggcaccaccagagaaacacacguugugguacauuaccuggua

SEQ ID NO: 8200 - RNA, 54 nt, Artificial Sequence
  Description of Artificial Sequence:  Enzymatic Nucleic Acid
ccggcuccagaaggugugaccagagaaacacacguugugguacauuaccuggua

SEQ ID NO: 8201 - RNA, 54 nt, Artificial Sequence
  Description of Artificial Sequence:  Enzymatic Nucleic Acid
gucugcccagaagugaccaccagagaaacacacguugugguacauuaccuggua

SEQ ID NO: 8202 - RNA, 54 nt, Artificial Sequence
  Description of Artificial Sequence:  Enzymatic Nucleic Acid
uauucaucagaagcccagaccagagaaacacacguugugguacauuaccuggua

SEQ ID NO: 8203 - RNA, 54 nt, Artificial Sequence
  Description of Artificial Sequence:  Enzymatic Nucleic Acid
ucucccaaagaagcuauuaccagagaaacacacguugugguacauuaccuggua

SEQ ID NO: 8204 - RNA, 54 nt, Artificial Sequence
  Description of Artificial Sequence:  Enzymatic Nucleic Acid
cuggcccgagaagagaauaccagagaaacacacguugugguacauuaccuggua

SEQ ID NO: 8205 - RNA, 54 nt, Artificial Sequence
  Description of Artificial Sequence:  Enzymatic Nucleic Acid
cacaggggagaagguaccaccagagaaacacacguugugguacauuaccuggua

SEQ ID NO: 8206 - RNA, 54 nt, Artificial Sequence
  Description of Artificial Sequence:  Enzymatic Nucleic Acid
ucucaucaagaagaaaacaccagagaaacacacguugugguacauuaccuggua

SEQ ID NO: 8207 - RNA, 54 nt, Artificial Sequence
  Description of Artificial Sequence:  Enzymatic Nucleic Acid
ccagucucagaagacagaaccagagaaacacacguugugguacauuaccuggua

SEQ ID NO: 8208 - RNA, 54 nt, Artificial Sequence
  Description of Artificial Sequence:  Enzymatic Nucleic Acid
gggcugcaagaagucucaaccagagaaacacacguugugguacauuaccuggua

SEQ ID NO: 8209 - RNA, 54 nt, Artificial Sequence
  Description of Artificial Sequence:  Enzymatic Nucleic Acid
ccacagugagaagcaggcaccagagaaacacacguugugguacauuaccuggua

SEQ ID NO: 8210 - RNA, 54 nt, Artificial Sequence
  Description of Artificial Sequence:  Enzymatic Nucleic Acid
cacacugcagaagacaagaccagagaaacacacguugugguacauuaccuggua

SEQ ID NO: 8211 - RNA, 54 nt, Artificial Sequence
  Description of Artificial Sequence:  Enzymatic Nucleic Acid
cuguucucagaaguuucuaccagagaaacacacguugugguacauuaccuggua

SEQ ID NO: 8212 - RNA, 54 nt, Artificial Sequence
  Description of Artificial Sequence:  Enzymatic Nucleic Acid
aaaccucaagaagcuguuaccagagaaacacacguugugguacauuaccuggua

SEQ ID NO: 8213 - RNA, 54 nt, Artificial Sequence
  Description of Artificial Sequence:  Enzymatic Nucleic Acid
uuauuaaaagaagaauaaaccagagaaacacacguugugguacauuaccuggua

SEQ ID NO: 8214 - RNA, 54 nt, Artificial Sequence
  Description of Artificial Sequence:  Enzymatic Nucleic Acid
agucuuuaagaagaaccaaccagagaaacacacguugugguacauuaccuggua

SEQ ID NO: 8215 - RNA, 11 nt, Artificial Sequence
  Description of Artificial Sequence:  Generic Nucleic Acid Substrate
  misc_feature (1)..(4): n stands for any a, c, g, or u
  misc_feature (7)..(11): n stands for any a, c, g, or u
nnnnuhnnnnn

SEQ ID NO: 8216 - RNA, 28 nt, Artificial Sequence
  Description of Artificial Sequence:  Enzymatic Nucleic Acid
  misc_feature (1)..(5): n stands for any a, c, g, or u
  misc_feature (13)..(18): n stands for any a, c, g, or u
  misc_feature (24)..(27): n stands for any a, c, g, or u
nnnnncugangagnnnnnncgaaannnn

SEQ ID NO: 8217 - RNA, 15 nt, Artificial Sequence
  Description of Artificial Sequence:  Generic Nucleic Acid Substrate
  misc_feature (1)..(7): n stands for any a, c, g, or u
  misc_feature (9)..(9): n stands for any a, c, g, or u
  misc_feature (13)..(15): n stands for any a, c, g, or u
nnnnnnnynghynnn

SEQ ID NO: 8218 - RNA, 47 nt, Artificial Sequence
  Description of Artificial Sequence:  Enzymatic Nucleic Acid
  misc_feature (1)..(4): n stands for any a, c, g, or u
  misc_feature (9)..(19): n stands for any a, c, g, or u
  misc_feature (25)..(31): n stands for any a, c, g, or u
  misc_feature (39)..(47): n stands for any a, c, g, or u
nnnngaagnnnnnnnnnnnaaahannnnnnnacauuacnnnnnnnnn

SEQ ID NO: 8219 - RNA, 85 nt, Artificial Sequence
  Description of Artificial Sequence:  HDV Enzymatic Nucleic Acid
uggccggcauggucccagccuccucgcuggcgccggcugggcaacauuccgaggggaccguccccucgguaauggcgaaugggac

SEQ ID NO: 8220 - RNA, 176 nt, Artificial Sequence
  Description of Artificial Sequence:  Neurospora Enzymatic vs Nucleic Acid
gggaaagcuugcgaagggcgucgucgccccgagcgguaguaagcagggaacucaccuccaauuucaguacugaaauugucguagcaguugacuacuguuaugugauugguagaggcuaagugacgguauuggcguaagucaguauugcagcacagcacaagcccgcuugcgagaau

SEQ ID NO: 8221 - RNA, 15 nt, Artificial Sequence
  Description of Artificial Sequence:  flt-1 Target sequence
guaugguuaaaagau

SEQ ID NO: 8222 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
aucuuuucugaugaggcgaaagccgaaaccauac

SEQ ID NO: 8223 - RNA, 36 nt, Artificial Sequence
  Description of Artificial Sequence:  Enzymatic Nucleic Acid
  misc_feature (2)..(5): Phosphorothioate 3'-Internucleotide Linkage
  misc_feature (1)..(8): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-amino
  misc_feature (12)..(12): 2'-deoxy-2'-amino
aucuuuucugaugaggccgaaaggccgaaaccauac

SEQ ID NO: 8224 - RNA, 13 nt, Artificial Sequence
  Description of Artificial Sequence:  flt-1 Target sequence
cagacuacaacuc

SEQ ID NO: 8225 - RNA, 32 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
gaguggcugaugaggcgaaagccgaaagucug

SEQ ID NO: 8226 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (11)..(11): 2'-deoxy-2'-amino
gaguugcugaugaggccgaaaggccgaaagucug

SEQ ID NO: 8227 - RNA, 34 nt, Artificial Sequence; identical to SEQ ID NO: 8222
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-C-Allyl

SEQ ID NO: 8228 - RNA, 32 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (11)..(11): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-C-Allyl
gaguugcugaugaggcgaaagccgaaagucug

SEQ ID NO: 8229 - RNA, 10 nt, Artificial Sequence
  Description of Artificial Sequence:  Example of Stem II sequence
  misc_feature (2)..(9): n stands for any nucleotide and can be optionally absent
gnnnnnnnnc

SEQ ID NO: 8230 - DNA, 21 bp, Artificial Sequence
  Description of Artificial Sequence:  KDR 21 antisense primer
gcagcaggttgctctccatcc

SEQ ID NO: 8231 - DNA, 21 bp, Artificial Sequence
  Description of Artificial Sequence:  Scrambled control primer
ctgccaacttcccatgcctgc

What is claimed is:

1. An enzymatic nucleic acid molecule, comprising a sequence complementary to any of the substrate sequences identified as SEQ ID NO:1597, 1641, 1892, 2086, or 2119.

2. The enzymatic nucleic acid molecule of claim 1, wherein said enzymatic nucleic acid molecule is a ribozyme.

3. The enzymatic nucleic acid molecule of claim 2, wherein said enzymatic nucleic acid molecule is in a hammerhead motif.

4. The enzymatic nucleic acid molecule of claim 2, wherein said enzymatic nucleic acid molecule is in a hairpin, hepatitis Delta virus, group I intron, VS nucleic acid or RNase P nucleic acid motif.

5. The enzymatic nucleic acid molecule of claim 1, wherein said enzymatic nucleic acid molecule comprises between 12 and 100 bases complementary to the RNA of KDR receptor.

6. The enzymatic nucleic acid molecule of claim 5, wherein said enzymatic nucleic acid molecule comprises between 14 and 24 bases complementary to the RNA of KDR receptor.

7. A mammalian cell comprising the enzymatic nucleic acid molecule of claim 1, wherein said mammalian cell is not a living human.

8. The mammalian cell of claim 7, wherein said mammalian cell is a human cell.

9. An expression vector comprising nucleic acid sequence encoding one or more of the enzymatic nucleic acid molecules of claim 1.

10. A mammalian cell comprising an expression vector of claim 9, wherein said mammalian cell is not a living human.

11. The mammalian cell of claim 10, wherein said mammalian cell is a human cell.

12. An enzymatic nucleic acid molecule comprising any ribozyme sequence identified as SEQ ID NO:5753, 5797, 6048, 6242, or 6275.

* * * * *